United States Patent 9,862,959 (TRANSGENIC PLANTS WITH ENHANCED AGRONOMIC TRAITS) - sequence listing, part 3

SEQ ID NO: 8319 - protein, 530 aa, Unknown
  Nocardioides sp. JS614
MRVALEAGAGTEPVVVVADQRAERDVVGVVVLAEGERVPGEESGPAGEVPISSPADLDAHRHHCAVPPASPDSSPGSRSGSPAGSSLPQLPPGFRFGTSTASYQIEGAATEDGKGPSVWDTFTAEEGRIVDGSSGAVACDHYHRYGEDVALMKRLGAGGYRFSLSWPRIQPTGSGPANPKGLDFYDRLIDELLANGVQPMATLYHWDLPQALEDDGGWLNRATVDRFAEYAAIVGERFADRVEHWIPVNEPNVVMMMGYAVGFQAPGRTLMFDSMPVAHHLLLAHGRAAVELRAAGATSIGCANNHSPMWPASDDEADVGATKLFDALWNGMFTEPMLLGRYPADLQPLMADVVCDGDLSVIRQPLDFYGVNYYHPFKIGAAREDAEMPFEFRELVGYPTTDFGWPVVPDALREWLITLRARYRAALPPIYITESGCSYNMGPDEFGVVDDQPRIDYLDAHLRAVATACQRGVDVRGYYTWSLMDNFEWSEGYTQRFGLVHVDFDTQVRTPKRSFQWYADVIARQTRSVG

SEQ ID NO: 8320 - protein, 441 aa, Arabidopsis thaliana
MANKYVSSVLKSLLLLLHLVFLSKQHVDSASIVKSLPGFEGPLPFELETGYIGVGEEEEVQLFYYFIKSERNPKEDPLLLWLSGGPGCSSISGLLFENGPLAMKLDVYNGTLPSLVSTTYSWTKTSSMIFLDQPVGTGFSYSRTQQFNKPSDSGEAKRIHEFLQKWLGKHQEFSSNPFYVAGDSYSGLVVPATVQEISKGNYECCNPPINLQGYVLGNPLTDYATGCNCRIPFAHGMALISDELYESLKKTCKGEYTNVHPRNTQCLKFVEEFNKCTNRICQQLILDPLCETETPDCYIYRYLLTTYWANDATVREALQINKESIGEWVRCYYGIPYNNDIKSSMPYHVNNSISGYRSLIYSGDHDFEVPFLGTQAWIRSLNYSIIDDWRPWMVKNQIAGYTRTYANKMTFATIKGGGHTAESKPEEASIMFQRWINGQPL

SEQ ID NO: 8321 - protein, 488 aa, Streptomyces coelicolor
MPENNQKPLTTVAGPPVPDNQNSLTSGPRRPMLLQDVWFLEKLAHFDREVIPERRMHAKGSGLFGTFTVTHDITRYTSAKIFSEIGKKTPLFTRFSTVAGERGAADAERDIRGFAVKFYTDEGNWDLVGNNTPVFFFRDPLKFPDLNHAVKRDPRTNLRNAENNWDFWTNLPEALHQVTIVMSDRGIPASYRHMHGFGSHTYSLINAEGERFWVKFHHRTQQGIKNLTDAEAEALVGKDRESHQRDLFDAIEDGDFPKWKLFIQVMPEADAENYRFHPFDLTKVWSKKDYPLIEVGEWELNRNPDNYFADVEQAAFSPANVVPGIEASPDRMLQGRLFSYGDAQRYRLGVNHHHQIPVNAPKNPVNSYHRDPAMRVDGNQGATPGIEPNSYGRWQEQPAYRDPAQAVGAVADRFNYREDDDNYFEQPGNLFRQMSPEQQQVLFENTARAIDGASAQTIERHIGNCTQADPAYGAGVRKAIEALAAGNL

SEQ ID NO: 8322 - protein, 165 aa, Oryza sativa
  misc_feature (11)..(11): Xaa can be any naturally occurring amino acid
  misc_feature (52)..(52): Xaa can be any naturally occurring amino acid
  misc_feature (90)..(90): Xaa can be any naturally occurring amino acid
  misc_feature (116)..(116): Xaa can be any naturally occurring amino acid
  misc_feature (124)..(124): Xaa can be any naturally occurring amino acid
  misc_feature (135)..(135): Xaa can be any naturally occurring amino acid
MSLIRRSNVFXPFSFDLWDPFDGFPFGSGSRSSGSIFPSFPRGTSSETAAFXPGARIDWKETPEAHVFKADVPGLKKEEVKVEVEDGNVXSRSAASAARSQEEKTDKWHRVERSSXGKFLRRFXRLPENTKPEQXKASMENGVLTVTVPKEEPKKPDVKSIQVTG

SEQ ID NO: 8323 - protein, 502 aa, Secale cereale
MDGGGEHSEALKNYYLGKILGVGTFAKVIIAEHKHTRHKVAIKVLNRRQMRAPEMEEKAKREIKILRLFIDLIHPHIIRVYEVIVTPKDIFVVMEYCQNGDLLDYILEKRRLQEDEARRTFQQIISAVEYCHRNKVVHRDLKPENLLLDSKYNVKLADFGLSNVMHDGHFLKTSCGSLNYAAPEVISGKLYAGPEIDVWSCGVILYALLCGAVPFDDDNIPNLFKKIKGGTYILPIYLSDLVRDLISRMLIVDPMKRITIGEIRKHSWFQNRLPRYLAVPPPDMMQQAKMIDEDTLRDVVKLGYDKDHVCESLCNRLQNEETVAYYLLLDNRFRATSGYLGAHYQQPMESASPSTRSYLPGSNDSQGSGLRPYYRVERKWALGLQQSRAPPRAIMIEVLKALKELNVCWKKNGDCYNMKCRWCPGFPRVSDMLLDANHSFVDDCAIKDNGDANSRLPAVIKFEIQLYKTKDDKYLLDMQRVTGPQLLFLEFCAAFLTNLRVL

SEQ ID NO: 8324 - protein, 249 aa, Pisum sativum
MGRGRVELKRIENKINRQVTFAKRRNGLLKKAYELSVLCDAEVALIIFSTRGKLYEFCSTSNMLKTLDRYQKCSYGAVEVSKPAKELESSYREYLKLKQRFENLQRTQRNLLGEDLGPLSSKDLEQLERQLDSSLKHVRSTKTQFMLDQLADLQNKEHMLVEANRSLSMKLDEINSRNQYRQSWEAGDQSMQYGDQQNAHSQSFFQQLDCNPTLQIGSDYRYNNVASDQIASTSQAQQQVNGFVPGWML

SEQ ID NO: 8325 - protein, 446 aa, Lotus corniculatus
MKKVRRRIGKYEVGRTIGEGTFAKVKFAKNSETGESVAIKIMDKTTILKHRMVEQIKREISIMKIVRHPNIVRLHEVLSSQTKIYIILEFVMGGELYDRIVQRGKLSEDESRRYFQQLIDAVAHCHKKGVYHRDLKPENLLLDAFGNLKVSDFGLSALTKQGVDLLHTTCGTPSYVAPEVLSNQGYDGAAADVWSCGVILYVLKAGYLPFEEADLSTLYRRTSAAEFVCPSWFSTGTTTLIHKILDPNPKTRVKIGEIRKDPWFQRNYLPLKLNEDEQVNLDDVQAVFDDIEDQYVPVQSEITEGGPLVMNAFEMITLSQGLNLSPLFDRHQDYVKRQTRFVSRKPAKVIISSIKVVAESMGLKLQSRNYKMRIEGLSANKAGQFAVVLEVYEVAPCLYMVDVRKAAGDTLDYHKFYKNLCAKLENIIWRPTETMPDSGLLRQMTL

SEQ ID NO: 8326 - protein, 243 aa, Pisum sativum
MSFPNESMPDSPQRKIGRGKIEIKRIENTTNRQVTFCKRRNGLLKKAYELSVLCDAEVALIVFSTRGRLYEYANNSVKASIERYKKACSDTSGAKSASETNAQYYQQEAAKLRVQISNLQNHNRQMMGEALSNMNGKELRNLESKLEKGISRIRSKKNEMLFAEIEYMQKREIELHNSNQALRAKISENDQRNNHNVNVLHGGTNFECIQPQQQFDSRSYFQVNELQPNNQYARQDQMSLQFV

SEQ ID NO: 8327 - protein, 190 aa, Dicksonia antarctica
DEHGEVVAEIRKSDLEPYLGLHYPATDIPQASRFLFMKNRVRMICDCRAIPVKVIQDRELRQPLSLAGSTLRAPHGCHGQYMANMGSAASLAMAVTVNDNEEESSSRNHLFKQRKLWGLVVCHHTTPRAVPFPLRSACEFLMQVFGLQLNMEVELSAQLREKHILRTQTLLCDMLLRDAPIGIVSKSPNI

SEQ ID NO: 8328 - protein, 369 aa, Arabidopsis thaliana
MSIEKPFFGDDSNRGVSINGGRYVQYNVYGNLFEVSKKYVPPLRPIGRGASGIVCAAWNSETGEEVAIKKIGNAFGNIIDAKRTLREIKLLKHMDHDNVIAIIDIIRPPQPDNFNDVHIVYELMDTDLHHIIRSNQPLTDDHSRFFLYQLLRGLKYVHSANVLHRDLKPSNLLLNANCDLKIGDFGLARTKSETDFMTEYVVTRWYRAPELLLNCSEYTAAIDIWSVGCILGEIMTREPLFPGRDYVQQLRLITELIGSPDDSSLGFLRSDNARRYVRQLPQYPRQNFAARFPNMSVNAVDLLQKMLVFDPNRRITVDEALCHPYLAPLHEYNEEPVCVRPFHFDFEQPSLTEENIKELIYRESVKFNP

SEQ ID NO: 8329 - protein, 97 aa, Glycine max
MAALGGNRDVAGSQNSLEIDGLARFAVEEHNKKQNALLEFEKVVSAKQQVVSGTLYTITLEAKDGGQKKVYEAKVWEKAWLNFKEVQEFKLVGDAPA

SEQ ID NO: 8330 - protein, 361 aa, Oryza sativa
MLRRWFCCTQFHAPYREHENEFPDIPEEKEGNGFAPKSDDPTKAPPPIEVPELSLDELKEKTDNFGSKALVGEGSYGRVYYATLDNGKQVAVKKLDASTEPEVDNDFLTQVSIVSRLRHENFVEMLGYCVEGNQRLVAYEFATMGSLHDILHGRKGVPGAQPGPALDWMQRVRIAIDAAKGLEYLHEKVQPSIVHRDIRSSNVLLFEDYKAKIADFNPSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPPPPPAVAPET

SEQ ID NO: 8331 - protein, 541 aa, Arabidopsis thaliana
MFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 8332 - protein, 439 aa, Staphylococcus xylosus
FLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAHG

SEQ ID NO: 8333 - protein, 448 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEQAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYG

SEQ ID NO: 8334 - protein, 450 aa, Staphylococcus xylosus
PRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEKAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYG

SEQ ID NO: 8335 - protein, 426 aa, Staphylococcus xylosus
REVIPERRMHATGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHCHIRQCYIAD

SEQ ID NO: 8336 - protein, 106 aa, Triticum aestivum
RAAARAGGKRGGYMEITGFSAPVREQIYKIASVNLCSNITGQILASLVMNPPKASDESYASYKAEKDGILASLARRAKALEIAFSKLEGITCNKAEGAMYLGRDHA

SEQ ID NO: 8337 - protein, 612 aa, Arabidopsis thaliana
MGAALLCLLYFLSFLTLSLSSVNIDCGTSLPGVDNNNLKWVGDQDFITSGDSATISSTTVEKSLTTLRYFPTGDSNCYSNIPVTKGGKVLVRTMFYYGNYDGKSSTPSFSVVFEGKHRGTLSISSAFEPYLLELIFSPAGGETSVCFVRTSSSSNPFVSSIEVVDLDDGMYAELGPGEGLFYQQRRAYGATEFLRSDLQGRFWLPSEINILVTGIQSTAVSIDTSGASNKPPESVLRNSWTGEGLSLVDPTLPSAGVPVYLAMYFSEPLESSLRSFNIFFGGKQVGRGPVVPLFGKATQVVVRDVVASSSTLLTLWSTSSALLPPMINAAELYVISKGTSESTGGNETGSGSGSGSGGSGGGGSGSSGSGSGGTSKGGTGGSNEVSPGGSTNGKSSKLPIILGVVSPVAFVLVAYVFIAIILANRRKVRLQALAMPTFEESSSKTKQNRANRVSETMSLVPTFFGGRRTNVFDPFSLDVWDPFEGFLTPGLTNAPAKDVAAFTNAKVDWRETPEAHVFKADVPGLKKEEVKVEVEDGNILQISGERSSENEEKSDTWHRVERSSGKFMRRFRLPENAKVEEVKASMENGVLSVTVPKVQESKPEVKSVDISG

SEQ ID NO: 8338 - protein, 465 aa, Staphylococcus xylosus
ENSMTAGPRGPLLMQDIYFLEQMAHFDREVIPERRMHAKGSGAFGTFTVTNDITKYTCASIFAEIGKQTEMFARFSTVAGERGAGDAERDIRGFALKFYTEEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYTAEEAEQVIAKDRDSSQRDLFNTIEQGNFPKWKMYIQVMTEEQARNHKDNPFDLTKVWYKDEYPLIEVGEFELNRNPENYFQDVEQRAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSYEEQQTLFKNTANEMSPVTDALKHRHIRHCYKADPAYGQGVAEAMG

SEQ ID NO: 8339 - protein, 542 aa, Solibacter usitatus
MAKQIVYSEASRQAILRGVNQLADAVKVTLGPKGRNVVLEKKFGGPTITKDGVTVAKEIELKDPLENMGAQMVREVASKTSDVAGDGTTTATILAQSIYREGVKAVAAGANPMALKRGIDKAVELATEEVKKLSKPVSGDMIAQVGTISANSDKTIGNIIADAMKKVGKDGVITVEESKTMVTELDTVEGMQFDRGYLSPYFVSDAERMEAVLEDPYILIHEKKISNMKDLLPLLEQIARSGKPLLIIAEEVEGEALATLVVNKLRGTLNACAVKAPGFGDRRKAMLEDIGILTGGKPIMEDIGVKLEGVRLEDLGRAKRVTVDKDNTTIVDGAGNPKGIEGRIKQLRAQIDETTSDYDREKLQERLAKLAGGVAVIKVGAATETEMKEKKARVEDALHATRAAVEEGIVPGGGVALLRAAKALATFKVDGDEQIGVSIVKRACEEPLRQIVSNSGTEGAIVVDKVRENANNNYGYNAATDTYEDLVAAGVIDPTKVTRSALQHAASIAGLMLTTEAMIAEIPEKKSAPAGGPGGHGPEMDY

SEQ ID NO: 8340 - protein, 267 aa, Pseudomonas fluorescens
MSVPAFGLGTFRLQGQVVIDSVSTALELGYRVIDTAQIYENEADVGEAIAASGIARDKLFITSKIWIANFAKDRLIESLKASLQKLQTDYLDLTLIHWPSPEDQVPVEEFMGALLEAKRLGLTRQIGVSNFTIDLMKQAIAAVGAENIATNQIELHPYLQNRKVVEFAQSQGIQITSYMTLAYGEVLKDPLIVQIAERLQATPAQVTLAWAMQSGYAVIPSSTKRANLQGNLGAMALTLSDADMALIATLDRGHRLTSPKGIAPQWD

SEQ ID NO: 8341 - protein, 464 aa, Scenedesmus obliquus
MHSRTNCLQTSVRAPQPHFRPFTAVKTCRQRCSTTAAAAKRDQAQEQQPWIQVGLGLAAAATAVAVGLGAAALPAQAVTSEQLLFLEAWRAVDRAYVDKSFNGQSWFKLRETYLKKEPMDRRAQTYDAIRKLLAVLDDPFTRFLEPSRLAALRRGTAGSVTGVGLEITYDGGSGKDVVVLTPAPGGPAEKAGARAGDVIVTVDGTAVKGLSLYDVSDLLQGEADSQVEVVLHAPGAPSNTRTLQLTRQKVTINPVTFTTCSNVAAAALPPGAAKQQLGYVRLATFNSNTTAAAQQAFTELSKQGVAGLVLDIRNNGGGLFPAGVNVARMLVDRGDLVLIADSQGIRDIYSADGNSIDSATPLVVLVNRGTASASEVLAGALKDSKRGLIAGERTFGKGLIQTVVDLSDGSGVAVTVARYQTPAGVDINKIGVSPDVQLDPEVLPTDLEGVCRVLGSDAAPRLFG

SEQ ID NO: 8342 - protein, 555 aa, Cryptococcus curvatus
MSASTKQASTTVAQPSGKPVTNVIDPERDDFIVPDNYVTRTVENMKMLPPVTWRNLHKNIQWISFLALTIPPAMAIYGLCTVPVQTKTFIWSVVYYFITGLGITAGYHRLWAHRSYNASKPLQYFLALCGAGSVQGSIRWWSRGHRAHHRYTDTKLDPYSAHEGFWHAHMGWMLIKPRGKIGVADISDLSKNPVVKWQHNNYVALLFFMGLAFPTLVAGLGWGDWWGGLFFAGAARLVFVHHSTFCVNSLAHWLGETPFDNKHTPKDHFITALVTVGEGYHNFHHQFPMDFRNAIKWYQYDPTKWFIWTMAQLGLASHLKKFPDNEIKKGQYTMKLMQLQEQSEKLEWPKHSNDLPVISWEDFQAESKTRALIAVHGFIHDCSSFIEDHPGGAHLIKRAIGTDSTTAFFGGVYDHSNAAHNLLAMMRVGVLDGGMEVEHLKVGRLTRSNSADSLVSDAPSSASSTVSASSILSEVEDMDKPERKPSTSRSPRCPTPGRSPCLLRRSIASSARPPRSAQDSSRASRAPPRPASHGQRALTLLSRLRAFSVEHPGFH

SEQ ID NO: 8343 - protein, 493 aa, Cryptococcus curvatus
MSASTATAPPATAPAVANPTPAAASAAAAAPAATKDKAETIDPESEHFVVSQNYVTRTVENMTMLPPVTWSNLLQNIQWISFTALTVPPAMAIYGLCTLELQRKTVIWAIVYYFMTGLGITAGYHRLWAHRAYNASAPLQYFLALCGAGSVQGSIKWWSRGHRAHHRYTDTKLDPYSAHEGFWWAHVGWMLVKPRGKIGVADISDLSRNPVVKWQHNNYVMLMVLMGLVFPTLVAGLGWGDWKGGLLFAGAARLVFVHHSTFCVNSLAHWLGETPFDNKHTPKDHFITALVTVGEGYHNFHHQFPMDFRNAIKWYQYDPTKWFIWTMSNVGLASHLKKFPDNEIKKGQYTMKLQMLQEQSGSIQWPKHSNDLPVISWEDFQAEAKERSLVAIHGFIHDCSSFLEDHPGGIHLIKKAIGTDATTAFFGGVYDHSNAAHNLLAMMRVGILDGGMEVESLKLENLQRSMSVSSMESDAASSASSVSVSSISPRWPH

SEQ ID NO: 8344 - protein, 297 aa, Oenococcus oeni
MEIKANKLTDTYTLNNNVQIPVIGFGTWQSADGEEAYNAVKWALEAGYRHIDTAAAYGNEESVGQAIKDSGVKREDLFVTTKLWNYQRDNYENSLRGFHDSITRLGLDYVDLYLIHWPEPIEYRDHWQSLNADSWRAMEKIYKDGKTRAIGVSNFREKHIDELMKTAEIAPMVNQIFLNPGDQEKDLVTYNKNHNILTEAYSPLGTGNLLDNPELKKLADKHGVDVAQILIRWNLEKGYLPLPKSTHQKYIESNKKVFSFQLDYDDHKTLDALDGQGKQHTDPHEHNFQKVVPFLNN

SEQ ID NO: 8345 - protein, 241 aa, Pisum sativum
MELPNEGGEGSSQKKLGRGKIEIKRIENTTNRQVTFCKRRNGLLKKAYELSVLCDAEVALVVFSTRGRLYEYANNSVRATIERYKKACAASTNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQQNLMPETMCESLPSQTYDRNFFPVNLLGSDQQEYSRQDQTALQLV

SEQ ID NO: 8346 - protein, 278 aa, Synechococcus elongatus
MTLAIRPKLAFNWPTALFMVAIHIGALLAFLPANFNWPAVGVMVALYYITGCFGITLGWHRLISHRSFEVPKWLEYVLVFCGTLAMQHGPIEWIGLHRHHHLHSDQDVDHHDSNKGFLWSHFLWMIYEIPARTEVDKFTRDIAGDPVYRFFNKYFFGVQVLLGVLLYAWGEAWVGNGWSFVVWGIFARLVVVYHVTWLVNSATHKFGYRSHESGDQSTNCWWVALLAFGEGWHNNHHAYQYSARHGLQWWEFDLTWLIICGLKKVGLARKIKVASPNN

SEQ ID NO: 8347 - protein, 760 aa, Mesorhizobium loti
MIAESDSQQANKGDDAVAAPAAARRFIAAPPLVPEQQLARREGLPLLTFVAIMVLAGLAHLTGAPIFISLALLATGLAGLALHLHARRSVHRTVVLLDETTARSRAEIETLADRMWEMQESEERFRGLIDALGDLVIHRDRDGYIVYANKVFADLVETDQRDLAGKTLAELGIEVGIVPDAAFSDHECLSSTDVAIRTPGGPRWFSWIELSVRDKDSGAASHRAIARDITARKRAESSLITARERAEYASQAKSRFLATVSHEIRTPMNGIMGMARLLADTSLSPEQQTYVGAISTSASALLALIEDLLDYSKIEAGRFDPEPQPMSVREIADNIIELLAARAFAKDIGLGCHVEPDVPQLITADPGRVRQVLLNLIGNAIKFTDGGGVLVSIARARSETSDRICFTITDTGPGLREEDMERIFEEFEQADGTSTRAHGGAGLGLAISKRLVAAMGGTISVSSRLGQGSEFVFEIPATEATEAPQGRQNVLAGRRAVILSRNAVEADAIARTIRANGGTAGIATTVAQAAPLAEGCDVLLVDAAMEESDGRVLKRLRQSGFTDCEAITLIAPTDRGMLGEFRASGYATFLARPVRGGTLLRVLLTSHAPALAQPQPEKRRTPALRASSDRQQGLSVLIAEDNDINAMLARATLLKAGHRVKVVGNGKAAVEAVTGAGHKHRFDVVLMDLHMPVMDGLDAIAAIRRHEEETSAPPVPIMVLSADSQEKTRHAVLAHGASGFVTKPLDPDALVNAVEGQVAA

SEQ ID NO: 8348 - protein, 196 aa, Glycine max
RQDTWTFESLIYKMVSFEMNDRKKIGLGLTGFGIFFSFLGLIFFFDKGLLAMGNILFVSGVSLTIGLKSTMQFFMKRSNFKGTISFGIGFFILILGWPILGMIVESYGFIVLFSGFWPTLAVFLQKIPVLGWLFQQPFVRSVSSCAEMSCPYNLKHLYTPFIKAIYFVILHSCLCVTVSIEDVHGGLKQMLLAVVW

SEQ ID NO: 8349 - protein, 1424 aa, Streptomyces avermitilis
MNSKTAEAESRTPGDQELRQLLAGLTAVRDGDFGTRLPDDTDGLLGEIATVFNGMIDQLSVFTSEVTRVAREVGTEGTLGGQAEVPGVSGTWADLTDSVNAMAGNLTTQVRDIAQVATAVAKGDLSQKIDVPARGEILELKETVNTMVDQLSAFADEVTRVAREVGSEGRLGGQAQVPGVGGVWRDLTDSVNLMAGNLTAQVRNVAQVTTAVAKGDLSQKITVDARGEILELKNTINTMVDQLSAFADEVTRVAREVGTDGRLGGQADVKDVRGTWRDLTDSVNFMAGNLTAQVRSIAQVATAVAKGDLSQKITVDARGEILELKDTINTMVDQLSAFADEVTRVAREVGTAGNLGGQATVRGVSGTWKDLTDNVNVMASNLTGQVRSIAQVATAVARGDLSQKITVEAKGEVAALADVINTMVDTLSAFADEVTRVAREVGTEGRLGGQAHVPNVAGTWKDLTDNVNSMANNLTGQVRNIALVTTAVANGDLSKKIDVDARGEILELKTTINTMVDQLSSFAAEVTRVAREVGSEGRLGGQAEVEGVSGTWKRLTENVNELAGNLTRQVRAIAEVASAVAEGDLTRSITVDASGEVAELKDNINSMVGSLRETTRANQEQDWLKSNLARISGLMQGHRDLAVVAELIMEELTPLVSAQYGAFYLAEETGRGTQLRLIGSYGYPDDTQRPDRIPLGRSLVGQAARNRRPITVDDLPPAYVTISSGLGQISPTALKVLPIVVDEQVLGVIELASVTRFTQIHEDFLGQLMETIGVNVNTIVANGRTDELLGESQRLTAELQSRSEELQVQQDELQRSNAELEEKATLLATQNRDIEAKNLQIEQARQELEARAQQLSLASKYKSEFLANMSHELRTPLNSLLILAQLLAQNPSHNLTPKQVEYAGIIHSAGSDLLQLINDILDLSKVEAGKMDISPERVALRRLLDYVEATFRPMTSQKSLEFTMSTAPGVPVDLLTDDSRLRQVLRNLLSNAVKFTERGGVGLHIEPAVDQNIPAAVHRGGAVVAFHVKDTGIGIPEQQLETIFGAFQQADGTTSRKYGGTGLGLSITREIAHLLGGAVTVDSTPGQGSTFTLYLPVARADFEELAQGAQPGEASQGDGAADHPRGSQALTGAGGPTHRRRRILVVEERPRGLLTLVAESTVANLTRGHHGGDPREVIDVTTTVDAQEAAGALAAEPCHCVVLELGMSGGEASRFLDALDGDPALASVPVLVHNGQRADVTLDPALRSRSAARSLEIFSSLDELRERIALHLSAEEPGDVLPLVRPEKPQPEQTLVVDGTFTGRTVLVVDDDARNLFALSGILELHGFKVLHAENGRKGVDTLLAHPEICLVLMDVMMPEMDGYAATTEIRSMSQYTDLPVVAVTAKAMPGDREKALQSGASDYVTKPVDANDLIACVRRWLSA

SEQ ID NO: 8350 - protein, 253 aa, Helianthus annuus
MGKGRLELKRIENKINRQVTFAKRRNGLLKKAYELSVLCDAEVALIIFSTRGKLYEFSSTSSMLKTLERYEKCSFGPPEQRKPAKEDLQEQSSYQEYMRLKERYDALKQLERNYYGEEIDSLTTNELESLERQLHCSLKQIRTIRTQSLIDKLYEQQKMEHQLYEYNKTLRLRLDEESQAEALQWDVHAHAHANGMVYGHHHQHQVSHPAHGAFYHPTGCETTLQIGYQTEQISGATSSSMSHHHHQMQGWPA

SEQ ID NO: 8351 - protein, 238 aa, Haemophilus influenzae
MLFALPALNDNYIWLYQRENLPLIIVDLPETDKLFAWLDKQNATIEAVLLTHEHDDHTQGVSAFKKRYPTVPIYGPQECEKKGATQIVNEGKILTANYQIDVIPTGGHTKQHVSFLVDNHLFCGDALFSAGCGRVFTGNYAQMFEGLQRLNTLPDETIVCPAHEYTLGNLAFAETVLVDKSAVEKSAVEKQRIFVETQRAENKLSLPTTLKLEREINPFLQAKTLEEFTALRKAKDIF

SEQ ID NO: 8352 - protein, 450 aa, Staphylococcus xylosus
PRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYG

SEQ ID NO: 8353 - protein, 221 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNIEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 8354 - protein, 477 aa, Pisum sativum
MGLENNSQKLLSKIATNNKHGENSPYFDGWKAYESNPFHPTKNPQGVIQMGLAENQLCFDLIEEWIKNNPKASICTPEGVNQFRHIANFQDYHGLPEFKNAVANLMSKVRGGRVRFDPDRLLMSGGATGANELIMFCLADPGDAFLVPSPYYPAFVRDLCWRTGLQLIPVQCHSSNNFMITREALEEAHKKAQDENINVKGLIITNPSNPLGTTIEKETLKSIVSFINENNIHLVCDEIYSGTFYDTPKFVSVSEIIQEMEDIKEDSIHTTYSLPKDLGLPGFRVGFVYSSTDEDVDCRTKNSSFGLLRRETQIFLLQILYDGKTQERFLRAVQKRLALRREVFTKGTPKVGIKCSQSYGGLLVCMHLSLKEKTVEGENDCRVIVHEVTIIVLPGVSFHCSEPGWYRVCFANMDEETVEIALMRIRAFVNGREKGVKKVEMKRWKSNLRLSFSSRRFEENVMSPHSPIPHSPLVRAT

SEQ ID NO: 8355 - protein, 545 aa, Rhodobacter capsulatus
MAAKEVKFSTDARDRMLKGVNILADAVKVTLGPKGRNVVIEKSFGAPRITKDGVSVAKEIELADKFENMGAQMVKEVASRTNDEAGDGTTTATVLAQAIVREGMKAVAAGMNPMDLKRGIDLATTTVVEAIKAAARPVKDSDEVAQVGTISANGEAQIGRFIADASQKVGNEGVITVEENKGMDTEVEVVEGMQFDRGYLSPYFVTNPDKMIADLEDAYILLHEKKLSSLQPMVPLLEAVIQSTRPLIIVAEDVEGEALATLVVNKLRGGLKIAAVKAPGFGDRRKAMLQDIAILTGGQVISDDLGMKLENVTLDMLGRAKKVTISKENTTIVDGHGDKAEINARVAHIRTQIEETTSDYDREKLQERVAKLAGGVAVIRVGGMTEVEVKERKDRVDDALNATRAAVQEGIIVGGGVALVQAAKKLNDLTGANSDQDAGISIVRRALEAPLRQIAENAGVDGAVVAGKVRESADPAFGFNAQTEEYGDMFGFGVIDPAKVTRTALEDAASIAGLLITTECMIAEKPEPKAAPAGGMGGMGGMDMM

SEQ ID NO: 8356 - protein, 87 aa, Neisseria meningitidis
VAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 8357 - protein, 496 aa, Staphylococcus aureus
MDDKQHTSSSDDERAEIATSNQDQETNSSKRVHLKRWQFISILIGTILITAVITVVAYIFINQKISGLNKTDQANLNKIENVYKILNSDYYKKQDSDKLSKAAIDGMVKELKDPYSEYLTKEQTKSFNEGVSGDFVGIGAEMQKKNDQIMVTSPMKGSPAERAGIRPKDVITKVNGKSIKGKALDEVVKDVRGKENTEVTLTVQRGSEEKDVKIKREKIHVKSVEYKKKGKVGVITINKFQNDTSGELKDAVLKAHKDGLKKIVLDLRNNPGGLLDEAVKMANIFIDKGKTVVKLEKGKDTEAIQTSNDALKEAKDMDISILVNEGSASASEVFTGALKDYNKAKVYGSKTFGKGVVQTTREFKDGSLLKYTEMKWLTPDGHYIHGKGIKPDVTIDTPKYQSLNVIPNTKTFKVGDDDKNIKTIKIGLSALGYKVDNETTQFDQALENQVKAFQQANKLEVTGEFNKETNNKFTELLVEKANKHDDVLDKLINILK

SEQ ID NO: 8358 - protein, 458 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAE

SEQ ID NO: 8359 - protein, 546 aa, Xanthomonas axonopodis
MAAKDIRFGEDARTRMVRGVNVLANAVKATLGPKGRNVVLEKSFGAPTITKDGVSVAKEIELADKFENMGAQMVKEVASKTNDNAGDGTTTATVLAQALIREGAKAVAAGMNPMDLKRGIDQAVKAAVVELKNISKPTTDDKAIAQVGTISANSDESIGNIIAEAMKKVGKEGVITVEEGSGLENELDVVEGMQFDRGYLSPYFINNQQSQSADLDDPFILLHDKKISNVRDLLPVLEGVAKAGKPLLIVAEEVEGEALATLVVNTIRGIVKVVAVKAPGFGDRRKAMLEDMAVLTGGTVISEEVGLALEKATIKDLGRAKKVQVSKENTTIIDGAGDSAAIESRVGQIKTQIEDTSSDYDREKLQERVAKLAGGVAVIKVGASTEIEMKEKKARVEDALHATRAAVEEGVVPGGGVALVRALVAVGDLKGANEDQTHGIQIALRAMEAPLREIVANAGEEPSVILNKVKEGTGNYGYNAANGEFGDMVEFGILDPTKVTRSALQNAASIAGLMITTEAMVADAPKKDEPALPAGGGMGGMGGMDF

SEQ ID NO: 8360 - protein, 265 aa, Digitalis lanata
PTCGVKCLLEEEAIKVGGANHSHATQDLYDSIAAGNYPEWKLFIQTIDPDHEDRFDFDPLDVTKTWPEDILPLQPVGRMVLNKNIDNFFAENEQLAFCPAIVVPGVYYSDDKLLQTRIFSYSDTQRHRLGPNYLQLPANAPKCAHHNNHHEGFMNFMHRDEEVNYFPSRYDPCRHAERFPHPPVALNGKRDRICIEKENNFKQPGEKYRSFPPDRQERFIKRWVDALSDPRLTHEIRSIWVSYWTQADKSLGQKLASRLNIRPTM

SEQ ID NO: 8361 - protein, 450 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEKAEQVMAKDRDSSQRDLFNNIEQGNFPKWKMYIQVMTEEQARNHKNNPFDLTKVWYKDEYPLIEVGEFELNRNPENYFQDVEQAAFATTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQG

SEQ ID NO: 8362 - protein, 464 aa, Arabidopsis thaliana
MENKPSVLTDKYDVGRLLGQGTFAKVYYGRSILTNQSVAIKMIDKEKVMKVGLIEQIKREISVMRIARHPNVVELYEVMATKTRIYFVMEYCKGGELFNKVAKGKLRDDVAWKYFYQLINAVDFCHSREVYHRDIKPENLLLDDNENLKVSDFGLSALADCKRQDGLLHTTCGTPAYVAPEVINRKGYDGTKADIWSCGVVLFVLLAGYLPFHDSNLMEMYRKIGKADFKAPSWFAPEVRRLLCKMLDPNPETRITIARIRESSWFRKGLHMKQKKMEKRVKEINSVEAGTAGTNENGAGPSENGADEPTNLNAFDLIALSAGFDLAGLFGDDNKRESRFTSQKPASVIISKLEEVAQRLKLSIRKREAGLFKLERLKEGRKGILSMDAEIFQVTPNFHLVEVKKSNGDTLEYQKLVAEDLRPALSDIVWVWQGEKDELTSQQETEYQQQQQQEQQEQEEPLKF

SEQ ID NO: 8363 - protein, 391 aa, Vigna radiata
YFDGWKAYDENPYDELTNPSGVIQMGLAENQVSFDLLEKYLEAHSEASTWGKGAPGFRENALFQDYHGLKTFRTAMASFMEQVRGGRAKFDPQRVVLTAGATAANELLTFILANPGDALLVPTPYYPGFDRDLRWRTGVNIVPIHCDNSNNFQITPEALEAAYKDAEAMKYKVRGVLITNPSNPLGVTIPRSVLEEILDFVTRKNIHLVSDEIYSGSVFSSSEFTSVAEILEGRQYRNAERVHIVYSLSKDLGLPGFRVGTIYSYNDKVDTTARRMSSFTLISSQTQHLLASMLSDKNFTENYIKTNRERLRKRYEMIIEGLKSAGIECLKGNAGLFCWMNMSPVLEKPTREGELELWNAILHEVKLNISPGSSCHCSEPGWFRVCFANMD

SEQ ID NO: 8364 - protein, 481 aa, Arabidopsis thaliana
MALKALDYDTLNENVKKCQYAVRGELYLRASELQKEGKKIIFTNVGNPHALGQKPLTFPRQVVALCQAPFLLDDPNVGMLFPADAIARAKHYLSLTSGGLGAYSDSRGLPGVRKEVAEFIQRRDGYPSNPELIFLTDGASKGVMQILNCVIRGNGDGILVPVPQYPLYSATISLLGGTLVPYYLDESENWGLDVANLRQSVAQARSQGITVRAMVIINPGNPTGQCLSEANIREILKFCYNEKLVLLGDEVYQQNIYQDERPFISSKKVLMEMGSPFSKEVQLVSFHTVSKGYWGECGQRGGYFEMTNLPPRVVEEIYKVASIALSPNVSAQIFMGLMVNPPKPGDISYDQFARESKGILESLRRRARLMTDGFNSCKNVVCNFTEGAMYSFPQIRLPTGALQAAKQAGKVPDVFYCLKLLEATGISTVPGSGFGQKEGVFHLRTTILPAEDEMPEIMDSFKKFNDEFMTQYDNNFGYSKM

SEQ ID NO: 8365 - protein, 296 aa, Zea mays
  misc_feature (88)..(88): Xaa can be any naturally occurring amino acid
METSAATPTRPPHQAATSPSPSPSSSLRLWRPAAQRNMRNQWSHLSAAKEQWLAAVADGRAHASALVNVHLSCRNMPTMDLGVLKDMXGIRDKANSKLALREEQYSGMLLSAYKEMVRQLSYLVEASHSMRRFSKAAPNCPITQFSDRQDNLNDSGDGGGAPVFKWFSVLEFESLAQELVQMFVSEQKLKRLLLLEFLSIALKEGVELQTSLNWGDELYDGESNKLQSIGLQSGDAYSPPENWCAERLGSQRPGNLPLHEVLQVYLTTWHANMNINRSRIDEIFELVEEEMKIKLS

SEQ ID NO: 8366 - protein, 474 aa, Zea mays
  misc_feature (341)..(341): Xaa can be any naturally occurring amino acid
TASAVLCAPRTRLVGSSIQLPPDVDQLPILTTKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKPENLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRILDPNPMTRITIPEILEDEITIPEILEDEWFKKGYKRPEFDEKYDTPLDDVDAVFNDSEEHHVTEXLISRSAGLNLGNLFDSEQEFKRETRFTSKCPPKETRFTSKCPPKEIIRKIEEAAKPLGFGVQKKNYKLRLEKVKAGRKGNLNVATEVAPSLHMVQVRKAKGDTLEFQKFYKNLSKTLKDVVWKSEDLQMRAAS

SEQ ID NO: 8367 - protein, 639 aa, Alkalilimnicola ehrlichei
MCGITGFWGGPAVDEGIAGRMAARIASRGPDDAGAWRDVKAGVALAHRRLSVIELSPAGHQPMRSPCGRYTLVYNGEIYNHLDLRVALETAGGAPDWRGYSDTETLLAALAHWGVPETLTRLNGMFAFALWDNREATLFLARDRMGEKPLYYGRNGGTFLFGSELKALTAYPGWQGQVDRDALALYLRYNHVPAPRSIYRGIGKLPPAHYVAVRDGGRNVGEPQCYWSLGEIAEQGVMQAGGSAHELADELDGLLRDAVGRRMAADVPLGSFLSGGFDSSMVAAQMQAQSERPVKTFSIGFHEAGYNEADHARAVATHLGTDHTELYITPEEAMAVIPELPAIFDEPFGDSSQIPTYLVSRMAREHVTVSLSGDGGDELFGGYNRHVVGPALWGRLARLPAPLRRGLGRAVGVAARIDRLPGAGRVPQLGEKLDKLASAMRASGGTAFYKDLLSHWKTPATVVRGASEPASLPDRIEAMPNLPGLRERMLYLDMMTYLPDDILTKVDRASMAVSLEARVPLLDHRLVAFAWRVPTDYKVRDGQGKWLFRRVLDRYVPRALMERPKMGFAVPIEHWLRGPLRDWAEVLLDERRLEREGFFHPAPIRRMWAEHLSGRRRHHAPLWNVLMFQAWSERQERIG

SEQ ID NO: 8368 - protein, 467 aa, Vigna radiata
MRLLSTIATCNSHGQDSSYFLGWQEYEKNPYDELHNPKGIIQMGLAENQLSFDLLESWLAKNPDVAGFKRDGKSIFRELALFQDYHGLPSFKKALVDFMSEIRGNKVTFDPNHIVLTAGSTSANETLMFCLAEQGDAFLLPTPYYPGFDRDLKWRTGAEIVPIQCTSSNNFQITEPALKQAYEEARKRNLRVKGLLVTNPSNPLGTTMSRSELNLLVDFIKEKKDTHLISDEIYSGTVFSSPGFVSVMEILKERNDTEEIWNRVHVVYSLSKDLGLPGFRVGAIYSENDTVVAAATKMSSFGLVSSQTQYLLSAMLGDKKFARNYIVENQKRLKRRQRMMVSGLQKAGISCLESNAGLFCWVDMRHLLHSNTFEAEMELWKKIVYQVGLNISPGSSCHCTEPGWFRVCFANMSEETLTLAMKRLKNFVVESTCTQRSALFNGTSKRKSLTKWVFRLSSRDHREQEER

SEQ ID NO: 8369 - protein, 459 aa, Lycopersicon pennellii
MAASVSTIGAASKAPLSLNNSVAGTSVPSTAFFGKSLKKVYAKGVSSPKVSNRNLRVVAQEVDETKEDRWKGLYDNTSDDQQDIARGKGLVDSLFQAPTGTGTHHAIMNSYEYVSQALKTYQLDNKLDGFYIAPAFMDKLVVHITKNFLTLPNIKVPLILGVWGGKGQGKSFQCELVFRKMGINPIMMSAGELESGNAGEPAKLIRQRYREAAEIIRKGNMCCLFINDLDAGAGRMGGTTQYTVNNQMVNATLMNIADNPTNVQLPGMYNKQENARVPIIVTGNDFSTLYAPLIRDGRMEKFYWAPTREDRIGVCKGIFRTDNVPEEAVVKIVDSFPGQSIDFFGALRARVYDDEVRKWVSGTGIELIGEKLLNSRDGPPTFEQPKMTLEKLLEYGNMLVQEQENVKRVQLAETYLKEAALGDANADAINTGISKNFTNLKSRLNNEEAKKARHVNFQE

SEQ ID NO: 8370 - protein, 441 aa, Phaseolus vulgaris
MAASLSTVGAVNRTLLNLNGSGGGASGPSSAFFGTSLKKVISSRVPNSKLTSGSFKIVAADKEIEETQQTEGDRWRGLAYDVSDDQQDITRGKGLVDSLFQAPMDAGTHYAVISSHKYLSAGLRQYNFDNIKDGFYIAPAFLDKLVVHIAKNFMTLPNIKVPLILGVWGGKGQGKSFQCELVFAKMGINPIMMSAGELESGNAGEPAKLIRQRYREASDLIKKGKMCVLFINDLDAGAGRLGGTTQYTVNNQMVNATLMNIADNPTNVQLPGMYNKEDNARVPIIVTGNDFSTLYAPLIRDGRMEKFYWAPTREDRIGVCKGIFRTDGVPEKDIVELVDKHPGQSIDFFGALRARVYDDEVRKWISGVGVDSVGKKLVNSKEGPPTFDQPKMTLDKLLLYASMLVQEQENVKRVQLADQYLNEAALGNANEDAIKSGSFFK

SEQ ID NO: 8371 - protein, 465 aa, Erwinia carotovora
MHDHLQNDFRFPANFWWGSASSAPQTEGESLSYGKSATVWDEWFATQPGRFHQQVGPADTSTFYQHWREDIALLKTLNHNTFRTSISWARLIPDGVGEPNPQAVAFYNQIIDEMLAQGITPFINLFHFDMPMVMQRLGGWENRAVVAAYAGYAATCFRLFGDRVKHWFTFNEPVVPVEGGYLYDFHYPNVVDFKRAATVAYHTMLAHALAVKAYREQSQGGEIGIILNLTPSYPRSQHPADVNAANIADLMFNRSFLDPALKGEYPQELVDLLHRYGQLPNCQPDDRALLADGVVDLLGINYYQPRRIQCRDSLVNPDSPFMPEWFFASYEMPGRKMNPYRGWEIYEPGVYDILTNLRVNYGNPRCFISENGMGVENEQRFDANGQIQDDYRIDFVREHLKQVHKGIAEGSNCLGYHMWTFIDNWSWSNAYKNRYGFVQLDLATQTRTVKKSGEWFATVAAENGF

SEQ ID NO: 8372 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFMDMLDGISSFVLLDTRDNSFIVARDAIGVTSLYIGWGLDGSVWISSELKGLNDDCEHFESFPPGHLYSSKERAFRRWYNPPWLSLAIPSAPYDPLALRHAFEKLWIKRLMTDVPFGVLLSGGLDSSLVAAVTARYLAGTKAAKQWGTKLHSFCVGLEGAPDLKATKEVAEYIGTVHHEFHYTVQDGIDAIEDVIYHIETYDVTTIRASIPMFLMSRKIKSLGVKWVISGEGSDVFFGGYLYFHKAPNKEEFHQETCRTIIVLHRYDCSRANKSTFVWGLEARVPFLDKEFIRVAMNIDPECKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSCRLTVPGGTSVACSTAKAVEWDAAWSNNLDPSGRAALGVHASAYGNQVKAVEPEKIIPKMEVSPLGVAI

SEQ ID NO: 8373 - protein, 528 aa, Glycine max
MAEVAAPKKENPNLLLGRFELGKLLGHGTFAKVHHARNIKTGEGVAIKIINKEKILKGGLVSHIKREISILRRVRHPNIVQLFEVMATKTKIYFVMEFVRGGELFNKVAKGRLKEEVARKYFQQLVSAVEFCHARGVFHRDLKPENLLLDEDGNLKVSDFGLSAVSDQIRHDGLFHTFCGTPAYVAPEVLARKGYDGAKVDIWSCGVVLFVLMAGYLPFHDRNVMAMYKKIYKGEFRCPRWFSSELTRLFSRLLDTNPQTRISIPEIMENRWFKKGFKQIKFYVEDDRVCSFDEKQLQHHDGDDYLATSDSEVEIRRKNSNCNSTSNGNSLPRPASLNAFDIISFSQGFDLSGLFEEKGDEARFVSSAPVSKIISKLEEVAQLVSFTVRKKDCRVSLEGCREGVKGPLTIAAEIFELTPSLVVVEVKKKGGDKAEYEKFCNSELKPALENLGMEDSASSSSSCHQSTHTQSEFQQQHRTFSDSALNRHSDNNECLYDQELGLAEETSIPQLGEPKFEFQQENVPMFTI

SEQ ID NO: 8374 - protein, 207 aa, Neisseria gonorrhoeae
NISVGTIFSILAKPEGALATESFLQTGRQQLAAGYVLYGPQTQLAFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 8375 - protein, 424 aa, Staphylococcus xylosus
FGTFTVTNDITKYTCASIFAEIGKQTEMFARFSTVAGERGAGDAERDIRGFALKFYTEEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYTAEEAEQVIAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSYEEQQTLFKNTANEMSPVTDALKHRHIRHCYKADSAYGQGVAEAMGID

SEQ ID NO: 8376 - protein, 712 aa, Ustilago maydis
MDRFDVINFADLSGPNGGEWVRIGGGSFGVVFKGEYLGTEVAIKEVLPNNTYDVEKYFERECVLMKEARHPNIVQYIGLTKSPGPDGRIYIISEFVGSNVRSYIADKSKPFPWRLRMSFAMDIARALAYLHARNCMHRDLKGENLLITANERIKVCDFGFARIAARNEEEMRRISYCGTDGYMSPEILLGVDFSLPSDVFSLGVIFAEIASRHLVDSYTFKRVMPTFGLDADEVREMASEGCPTAFIQLALDCVAEDPRDRPDMRQVVSRLRDIEREVLLREETENRYAIGSVRGATIQSIMGTKIKRAAPPKLPSFNGALKLNSSYSNAGSDDSGDEIEEALAALEKVGVEPDDARSPVTIKGSSTLKVAGHGNPWWSEDVPDALPSINRSWLASPGAAAERIRHESEAGLLEGADYAESDYSTSVVRSSKMTQRHAPLAMLEERASTLSVRTLRQGDSPLLIPTRRGSADVLAARSGSNDASAMQSYMTARTHRPDPSMALATIASVSSGLNEPIPICHRFTLVKNGTRRPNNVVAAAQQAMASSSTHQHPPPPVSSYYPSLVPPAVMLSNALAKCWVCGKRIGWKPFMDCDDCPYKTHVVCAELAPPTCQDLAIPLSSAVGGGSVQPILSPLNASRRNSKANDIVSCRRSSKAADVGDQREISAAAAALRRASLADSNDEPSSPQIGKAKAKKKLFGGSSAVNKSAVRA

SEQ ID NO: 8377 - protein, 461 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMG

SEQ ID NO: 8378 - protein, 216 aa, Magnetospirillum magnetotacticum
MQIMPDGPNDHLSFDPLDDTKRWPEDQFPLLKCGRMVLDRVPDNFFAEVEQSAFGTGVLVDGIDFSDDKMLQGRTLSYSDTQRYRVGANYLQLPINAPQPGVKVYSNQRDGQMTYGVDGTGPNKHINYEPSTLGQGLAEAPKKKEYHQPVSGNLGRYQTSRTEDDYAQAGHRYRTFEDWEREDLIANLVADMKQCPEPIQLRMVWHFWHADEDYGR

SEQ ID NO: 8379 - protein, 606 aa, Rhodospirillum rubrum
MTRRFGARVEGDGVRFSLWAPAAERVEVVIEGAAESRPVAMVPGGEGWFGAMVGGIGAGALYRFRIDGADLVPDPASRFQPRDVGGPSQVVDASGYAWKTDGWKGRPWAETVLYELHLGTFSRKGTYEGARARLGDLVDLGVSAIELMPLADFVGQRNWGYDGVLPFAPDSVYGTPEQLKALIDAAHGLGLMVFLDVVYNHFGPEGNWLGRYAPSFFTQAHQTPWGAAIDFERPEVRDFFVANALQWLEEYRFDGLRFDAVHAILDAEERHILGEIAVAVREALPADRHVHLVLENDANEARRLIGGTDVVAVRGRYDAQWNDDIHHAFHVVATGETGGYYADYAAQPLAHLGRCLAEGFAYQGESSAHRGGMARGEPTTALPPTAFVAFLQNHDQIGNRALGERLSTLAAPDRLRALRTILLLGPQIPMLFMGEEWSSSRPFLFFCDFHGDLAEAVREGRRREFAAFPQFSTPETRDRIPDPNAPETARACVLDWSERDQPTGAAVLAHHKHLLELRFAKIVPLLGRLRPGGGRCERIGEGGLAVRWGIDDGRDLLMLAQLAEAGSLPGAPPQADLIYRSDGGERAEAPLGPWSVLFALVPETSR

SEQ ID NO: 8380 - protein, 461 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTHQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMG

SEQ ID NO: 8381 - protein, 459 aa, Staphylococcus xylosus
MTAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAE

SEQ ID NO: 8382 - protein, 306 aa, Glycine max
  misc_feature (159)..(159): Xaa can be any naturally occurring amino acid
MGELTQAEVYSPRTQQVWRALLSWLAFFFQIFFQIIRALGHYPLLSFSSNSSSSSNASSSSSSFKPLPSVEIAEHDSPPPSALEISPLDYSPADHPVPKLTVVLDLDETLVCAYETSSLPAALRTQAIEGGLNWFELECVSIDKEGEGKKINYVTVFEXPGLKEFLKQLSEFADMVLFTAGLEGYARPLVDRIDVENRFSLRLYRPSTISTEYREHVKDLTCISKDLCRIVIVDNNPFSFVLQPVNGIPCIPFSAGQPHDTQLLDVILPLLKQLSEQNDVRPFLYEKFHMPDWFQKQGIPASSWTL

SEQ ID NO: 8383 - protein, 838 aa, Streptococcus pneumoniae
MNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKRM

SEQ ID NO: 8384 - protein, 489 aa, Escherichia coli
MHLLTLSINPTFLMRSNHFKEFKMDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 8385 - protein, 189 aa, Nymphaea alba
DQHGEVIAECKKPDLEPYLGLHYPATDIPQASRFLFMKNNLRMICDCTAPSVKVIQDKQLEQPLSLCGSTLRSPHGCHAQYMANMGSIASLVMSVVINDHDEEPAIDNSQKGTKLWPLVVCHHTRPRFIPFPLRYACEFLIQVFAVQLNKEVELAAQLREKHILRMQTVLCDMLLRDAPVGIVTRSPNV

SEQ ID NO: 8386 - protein, 310 aa, Kluyveromyces lactis
MSTSNESPSLKLNTGASIPVVGLGTWKSPEEDAYNAVVSALQNGYRHIDTAAIYGNEEAVGKGIRDSGVPREEIFVTTKLWGTQQRDPEAALDLSLQRLGLDYVDLYLIHWPVPLNASSITDGNYLTFPRTADGKIDIDIEEWNFIKTWEKMQHLPKSGKTKAIGVSNFSIKNIEALLAANPDFIVPAANQIEIHPQLPQTELIDYCKSKGILIEAYSPLGSSSSTILTDPTIEGIASKYNAEPANILISWGASRGYVVLPKSVNPQRIKTNLKLLDLSTEDLEKINKLTESVGAKRYVAPDFSPFAIFE

SEQ ID NO: 8387 - protein, 510 aa, Photorhabdus luminescens
MCGIGGVFNTENRLIDDIENKLQTIMSKIAHRGDPSRFNEKVVRNNFSIATNRLAIVERDSAYQPISNQEHDLHLVLNGQIYNYKSLRNELIKQGYQFKNGGDAEVALIAYICYGKSFIKKLDGMFSFILFDNKNNKFLLGRDHVGIKPLYYTQKEGNWYVASEIKSLIEFNSEIKPVEPGSIFDGLTSEKYISYDTTIPASSDNVEQAKEKIYSLLDNAVRKRVDTDLPVSIMFSGGIDSTIVLYLAKKYHHDITAISFGLPGSKDIEIAQRYCTENNIKHIIYTFTQEELINNIQDAIYYGEFFEQIDAIDSTIAHFGYYIANRLGFKIALCGEGSDEIFAGYDLFKTYPDPHHLSLYRLNNLHRTDLQRVDRASMRNTVEARVPFMDSALVPYVLSLDFSYKLNNGIEKYILREAFRGKIPEYIIDRPKIRMPDGSGVKNTIIDYVKDIKCNLPRNMVDSLNSIGLTHQSSLYFAEKYLSLGYPLPKERFKESGKDFSESGYFNFIS

SEQ ID NO: 8388 - protein, 477 aa, Listeria monocytogenes
MTESKFPKDFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEDNPEEVKYQAAHHQLVASALATKLGHEINPENQIGCMLAAGNTYPMTCNPKDVWKSIEADREGYFFIDVQARGHYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSITDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 8389 - protein, 465 aa, Staphylococcus xylosus
NSMTAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMGI

SEQ ID NO: 8390 - protein, 256 aa, Sinorhizobium meliloti
MAALELDLFLCRTDNYGVLLHDRLSGATASIDAPEERPILDALERRGWQLTHILTTHHHGDHVAANASLKERFGLTIIGPKNEASKIPGIDRTVGHGDRFDFAGHPVDVIETPGHTSGHVCYHLPEDKLLFAADTLFALGCGRLFEGTADTMWQSLSRLMALPDDTAIYFGHEYTLANAHFAITVDPENSALKERAAEIEETRSDGGFTAPTTMGLEKRTNPFLRAGDPKIRALLGMEKASDAAVFAEIRKRKDNF

SEQ ID NO: 8391 - protein, 457 aa, Staphylococcus xylosus
AGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAE

SEQ ID NO: 8392 - protein, 791 aa, Ralstonia metallidurans
MRVLCIGGGPAGLYFGLLMKLQNPSHEVIVVERNRPYDTFGWGVVFSDATLENLKQADPVSAAEINAAFNHWDDIDIHIGGRTIRSGGHGFIGIGRKRLLNILQARCEALGVKLVFETDVSDDQALARQYNADLVIASDGLNSRIRTRYAESFQPDIDTRQCRFVWLGTHKLFDAFTFAFEKTEHGWFQAHAYRFDDNTSTFIVEAPEPVWKAAGIEQMSQEEGVAYCEKLFAKYLDGNKLISNAAHLRGSAIWIRFPRVICHHWVHWNTLDDGRRVPVVLMGDAAHTAHFSIGSGTKLALEDAIDLAEAIGEHRAAGVDGLPEALARYEATRSVEVLKIQNAARNSTEWFENVERYAGMAPEQFAYSLLTRSQRISHENLRVRDAQYVDNFEQWLAAQAGVPQETLKLRAAAGDAALPPMFTPFTVRGVTLKNRVVVSPMAMYSSVDGVPGDFHLVHLGSRALGGAGMVVAEMTCVSPDARITPGCPGLWNDAQRDAWKRIVDFVHANGDTKIAMQLGHAGRKGSTQLGWEKMDYPLADGNWPLISASALPYMPDVSQVPREMTREDMDRVRDDFVANARRAAEAGFDWLELHCAHGYLLSSFISPLTNTRTDAYGGLLANRLRYPLEVFAAVRAVWPQDKPMSVRISAHDWVEGGITADDAVEIARAFKAAGADMIDCSSGQVSPDQTPVYGRMYQTPFADRIRNEAGIPTIAVGAIFEADHVDSIVAAGRADLCAIARPHLADPAWTLHEAARLGYRDVTWPKQYVSGKRQLETNLARAASYAQQPGK

SEQ ID NO: 8393 - protein, 455 aa, Staphylococcus xylosus
GPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVA

SEQ ID NO: 8394 - protein, 452 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVA

SEQ ID NO: 8395 - protein, 545 aa, Heliobacillus mobilis
MAKMTVFNEEARRALEKGVNTLAEAVRVTLGPKGRNVVLEKKFGSPLITNDGVTIAKEIELENPIENMGAQLVKEVATKTNDVAGDGTTTATILAQAIIREGMKNVAAGANPMVIKRGIEKAVATCVEEIKNLSKPVESKEAIAQVASISAADATIGSLIAEAMEKVGKDGVITVEESKGFSTDLEVVEGMNFDRGYISPYMITDPDKMEAVLNDPYILITDKKISAIKDILPVLERIVQSGKQLMIISEDIEGEALATLVVNKLRGTFTCVGVKAPGFGDRRKAMLEDIAILTGGRVVSEEVGLKLENATMDMLGRARQVRISKEETIIVDGAGSQDDIKARIAQIRRQYEESTSEFDKEKLQERLAKLAGGVAVIQVGAATETELKEKKLRIEDALNATRAAVEEGIVPGGGTALVSIQKALDEVEVPAGDEATGVAIIKRSLEEPLRQIANNAGYEGSVVVEKVKNLPKGQGFNAATEVYEDMIAAGIVDPAKVTRSALQNAASIAAMLLTTEAIVADKPEKKEAPGMPGGMPGMGGMDMGM

SEQ ID NO: 8396 - protein, 206 aa, Zea mays
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCACKGNIPYFETSAKDGTNVEDAFQCIVKNALKNEPEEELYVPDTVDVVGGNRAQRSSGCC

SEQ ID NO: 8397 - protein, 462 aa, Staphylococcus xylosus
TAGPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTHQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVAEAMGI

SEQ ID NO: 8398 - protein, 553 aa, Escherichia coli
ASIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 8399 - protein, 387 aa, Aspergillus nidulans
MAHQDSKLFQPLAINNGNITLKHRVVHAPLTRNRGVPESPVSTPEKPNRVWYPGDLSNGMPGVPGLFTPSQIAGWKRVVDAVHEKGGYIYAQLWHAGRATIPQMTGSPAVSASATVWDDPTECYSHPPVGATERVPYSAHPPIELTVDHIKRTIADYCAAAKAAMEAGFDGVEVHGGNGYLPEQFLSSNINKRTDEYGGSPEKRCRFVLELMDELAKTIGEENLAIRLSPFGLFNQARGEQRMETWTHLCKELKRTHPTLSYVSFIEPRYEQIFSTAEKDAFLSSWGLSNVDLTSFREIFGDTPFFSAGGWDQTNSWGVLESGRYDALLYGRYFTSNPDLVERLRTGTPFAPYDRSRFYGPFEDNRICYTDYPPATGHTDIRIEIQQ

SEQ ID NO: 8400 - protein, 740 aa, Cucumis melo
MENCYCIEPQWPADELLMKYQYISDFFIALAYFSIPLELIYFVKKSAVFPYRWVLVQFGAFIVLCGATHLINLWTFTMHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPINLPVISQVFSSNRALKISPNSPVASLRPRAGRYVAGEVVAVRVPLLHLSNFQINDWPELSTKRYALMVLMLPSDSARQWRVHELELVEVVADQVAVALSHAAILEESMRARDLLMEQNVALDLARREAETAIRARNDFLAVMNHEMRTPMHAIIALSSLLQETELTPEQRLMVETILKSSNLLATLINDVLDLSRLEDGSLQLDIGTFNLHAVFKEVLNLIKPVTLVKKLSLTLHLGPDLPVFAVGDEKRLMQAILNVVGNAVKFSKEGSISISAIVAKSETFREIRVPDFHPVPSDSHFYLRVQVKDTGSGISPQDIPKLFTKFAQTTVGPRNSGGSGLGLAICKRFVNLMEGHIWLESEGLGKGCTATFIVKLGIADQSNESKLPYTSKIHENSIHTSFPGLKVLVMDDNGVSRSVTKGLLVHLGCEVTTAGSIEEFLRVVSQEHKVVFMDICTPGVDGYELAIRIREKFAKCHERPFMVVLTGNSDKVTKESCLRAGMDGLILKPVSIDKMRSVLSELIERRVLFETS

SEQ ID NO: 8401 - protein, 161 aa, Arabidopsis thaliana
MSLIPSIFGGRRSNVFDPFSQDLWDPFEGFFTPSSALANASTARDVAAFTNARVDWKETPEAHVFKADLPGLKKEEVKVEVEDKNVLQISGERSKENEEKNDKWHRVERASGKFMRRFRLPENAKMEEVKATMENGVLTVVVPKAPEKKPQVKSIDISGAN

SEQ ID NO: 8402 - protein, 805 aa, Arabidopsis thaliana
MVVIHGVSLTPRFTLPSRPLNTGFNAGNSTLSFFFKKHPLSRKIFAGKQSAEFDSSSQAISASEKVLVPDNLDDDPRGFSQIFDLESQTMEYTEAVRTEDQTMNVVKERGVKPRIVPPPGDGKKIYEIDPMLRTYNNHLDYRYGQYKRLREEIDKYEGGLEAFSRGYEKLGFSRSDAGITYREWAPGAKAASLIGDFNNWNSNADIMTRNEFGVWEIFLPNNTDGSPAIPHGSRVKIRMDTPSGIKDSIPAWIKFSVQAPGEIPFNGIYYDPPEEEKYVFKHPQPKRPKSLRIYEAHVGMSSTEPMVNTYANFRDDVLPRIKKLGYNAVQIMAIQEHSYYASFGYHVTNFFAPSSRCGTPEELKSLIDRAHELGLVVLMDIVHSHASKNTLDGLNMFDGTDAHYFHSGPRGYHWMWDSRLFNYGSWEVLRYLLSNARWWLEEYKFDGFRFDGVTSMMYTHHGLSVGFTGNYTEYFGLETDVDAVNYLMLVNDMIHGLYPEAITVGEDVSGMPTFCIPVQDGGVGFDYRLHMAIADKWIEMLKKRDEDWQMGDIIYTLTNRRWSEKCISYAESHDQALVGDKTIAFWLMDKDMYDFMAVDRPSTPLIDRGIALHKMIRLITMGLGGEGYLNFMGNEFGHPEWIDFPRGEQRLSDGSVIPGNNFSYDKCRRRFDLGDADYLRYRGLQEFDQAMQHLEENYGFMTSEHQFISRKDEADRVIVFERGDLVFVFNFHWTSSYFDYRIGCSKPGKYKIVLDSDDPLFGGFNRLDRKAEYFTYDGLYDERPCSFMVYAPCRTAVVYALANHD

SEQ ID NO: 8403 - protein, 771 aa, Ralstonia eutropha
MKLQDPANEVIVAERNRPYDTFGWGVVFSDATMDNLKVADPVSAAEINEAFNHWDDIDVHIGGRTIRSGGHGFIGIGRKRLLNILQARCEALGVKLVFETDVSDDQALAMQYQADLVIASDGLNSRIRTRYAGTFQPDIDTRQCRFVWLGTHKLFDAFTFAFEKTEHGWFQAHAYRFDDNTSTFIVETPQEVWSAAGIEQMSQEEGIAYCEKLFAKYLDGNKLISNATHLRGSANWIRFPRVICKHWVHWNTLPDGRRVPVVLMGDAAHTAHFSIGSGTKLALEDAIDLATEIAASGPSAHDALPAALERYAATRSVEVLKIQNAARNSTEWFENVERYASLAPEQFAYSLLTRSQRISHENLRVRDAGYVRKFEHWLAGEAGVPAESLRLREDKPVPPMFTPYRVRGVTLKNRVVVSPMAMYSSVDGVPGDFHLVHLGSRALGGAGMVVAEMTCVSPDARITPACPGLWNDAQRDAWKRIVDFVHANSDARIAMQIGHAGRKGSTQLGWEKMDHPLPHGNWPLFSASPIPYLPGESQVPREMTREDMDRVRDDFVGAARRAAEAGFDWLELHCAHGYLLSSFISPLSNQRTDEYGGTLANRLRYPLEVFAAVREVWPADKPMSVRISAHDWVEGGITPDDAVEIARAFKAVGADMIDCSSGQVSPDQAPVYGRMYQTPFADRIRNEADIPTIAVGAIFEADHVDSIIAAGRADLCAVARPHLADPAWTLHEAAKLGYRDVSWPRQYEAGKRQLETNLERAAALARAVVEH

SEQ ID NO: 8404 - protein, 546 aa, Tetragenococcus halophilus
MAKDIKFSEDARRSMLNGVSKLADTVKVTLGPRGRNVVLEKSYGSPLITNDGVTIAKEIELENRFENMGAQLVSEVASKTNDIAGDGTTTATVLAQSIVSEGLKNVTSGANPLGIRRGIEQATQKAVEELQNISTPVESKEAIVQVGEVSSGSKQVGQYIADAMDKVGNDGVITIEDSQGIDTELDVVEGMQFDRGYLSQYMVTDNEKMEADLDSPYILITDKKISNIQDILPLLEQVVQESKPLLIIADDIDGEALPTLVLNKIRGTFNVVATKAPGFGDRRKAMLEDIAVLTGATVITEDLGLELKDATMDSLGKANKVTVDKDNTTIVEGAGDSTAIEDRVQLIKNQVAETTSDFDREKLQERLAKLAGGVAVIKVGAATETEQKELKLRIEDALNAARAGVEEGMVSGGGTALVNVINKVAELDADDDAITGVNIVLRALEEPVRQISENAGFEGSVIIEKLKSEKLGIGFNAATGQWVNMVDAGIVDPTKVVRSALQNAASISALLLSTEAVIADRPDESGNDAGAGAQGMDPSMMGGGMM

SEQ ID NO: 8405 - protein, 393 aa, Cryptococcus neoformans
MTVIQSPKLFTPIQVGEYELKHRIVMAPLTRLRAETKTAIPSEWAETYYSQRASDGGLIVSEGTFIAEELRGYENVPGIYTPEQIAVWKKITSGVHSKGGRIFCQLWVLGRVADPNVIPVIYSVGTIRDDSPSYIAAPEPEGQRKPLTPVTEADMDRFIGHYIQASKNAIEAGFDGVEIHGANGYFIDQFLQTNSNDRTDQYGGSLENRMRFPLRVLNAVCDAIGPKRVGIRMSPFSEFQSMRMEDPLATFVPWAQAIVEAQPELAFIHAVEGRGILTPENEWYIQDNLNPIREVILNKGKSVRFIPAGGYMPDTAFEHAEKYPEDLIAFGRYFISNPDLPNRVRNGWPLHKYDRTTFYSQSSVGYNDYKDYKPETEALAQDEAAPKEGTTKA

SEQ ID NO: 8406 - protein, 679 aa, Pseudomonas syringae
MTAAHYPHLLAPLDLGFTTLRNRTLMGSMHTGLEERPGGFERMATYFAERARGGVGLMVTGGIAPNEEGGVYDGAAKLTNAKEAERHRIVTQAVHDAGGKICLQILHAGRYAYSRKQVAPSAIQAPINPFTPRELDEEGIEKQIADFVTCSTLARSAGYDGVEIMGSEGYFINQFLAAHTNHRTDRWGGSYENRMRLAVEIVRRVREAVGAQFIIIFRLSMLDLVEGGSSWEEIVELAKAVEQAGATLINTGIGWHEARIPTIATKVPRAAFSKVTAKLRGSVSIPLITTNRINTPEVAERILSEGDADMVSMARPFLADPEFVNKAAAGHAERINTCIGCNQACLDHTFGGKLTSCLVNPRACHETELNYLPTLQIRKIAVVGAGPAGLAAATVAAQRGHEVTLFDSASEIGGQFNIAKRVPGKEEFAETLRYFRNKVQETGVQLRLGNRVKAADLLDAGFDEVILATGIAPRTPAIPGIDNPMVLSYLDVILQRKPVGRRVAVIGAGGIGFDVSEFLVHQGVATSLDREAFWKEWGIDMTLQARGGVAGVKPEVHAPARQVFLLQRKSSKVGDGLGKTTGWIHRTGLKNKQVQMLNAVQYLKIDDAGLHIRIGEDGEEKLLAVDNVVICAGQDPLRELYDDLLNAGQSVHLIGGADVAAELDAKRAIDQGSRLAATL

SEQ ID NO: 8407 - protein, 459 aa, Streptococcus pneumoniae
MLRFPKDFVWGSSTSGPQTEGRVAGDGKGDNLWDYWFQVEPNRYYNGIGSDKTSTFYENWERDIELLLETGHTAFRTSIQWSRIFPQGCGKVNTQGVDFYRKVFEAIKAKGIRLLVNLYHFDLPFALQEDGDGWENKATVSAYEDYARFCFETYGDLVDQWITFNEPIVPVEFGYFYDAHYPHKVDAEAAVKVAYHTQLASSRAVKACHELLPDSKIGIVLNLTPAYPRSQHPADVKAARIAALFQAQSFLDPSVLGTYPQELVEILHEHGLLPDATEEELELIRDNTVDFLGVNYYQPLRVMAPRFAKHPESPLLPEHFYEPYVMPGRKINSHRGWEIYEQGIYDIAQNIKENYGNIEWMLTENGMGVEGEEKFRQDGMIQDDYRIDFVKGHLRELHRAIEDGANCKGYLIWTFIDCWSWLNSYKNRYGLVELDLETQERRLKKSGHWFKELSDNNGF

SEQ ID NO: 8408 - protein, 538 aa, Chlorobium tepidum
MSRIFTVIIMLLIGGFGYFIGWRMNSGTGGKMVDTYNLIRSYYVDPVNADSLQSAGVRGMLQSLDPHSIYLEPEKAAITQSNFNGNFEGIGVEFDVVRDTLLVVTPLAGGPSESAGIMPGDRIIGIDSKNVIGIKPSAVLGKLRGERGTRVRLRIYRPLTRRTIDFLVTRGKISTSSIDAAFLDDARTGYIRISQFVETTGSEFHNAVQKLRDKGMRKLIIDVRGNPGGYLDQAVAVADELLPAGKLIVYTKSRHGGDDQMKYLSTSGGIFEKGEVCLLVDRGSASAAEILAGALQDNRRALLIGELTFGKGLVQRQFKLPDDSVVRLTVSRYFTPSGRQIQREYDDGLQGRERYYKEMFTRNLPGGFIKKYGDLMYREGQNISVYSTGSLLKNTAADSLRAVLAKAGGIMPDYWVFGKPYSNLYQELYAKGVIEDIALKLIDDPSDPVQKYRSSATSYLDGYHVPVNLEALVRKECAEAKVQFNQAEFDRDRADIALALKARVARHLFGTEEQIRVLVSEGDPVMKVARHFIEKSAS

SEQ ID NO: 8409 - protein, 799 aa, Zea mays
MAFRVSGAVLGGAVRAPRLTGGGEGSLVFRHTGLFLTRGARVGCSGTHGAMRAAAAARKAVMVPEGENDGLASRADSAQFQSDELEVPDISEETTCGAGVADAQALNRVRVVPPPSDGQKIFQIDPMLQGYKYHLEYRYSLYRRIRSDIDEHEGGLEAFSRSYEKFGFNASAEGITYREWAPGAFSAALVGDVNNWDPNADRMSKNEFGVWEIFLPNNADGTSPIPHGSRVKVRMDTPSGIKDSIPAWIKYSVQAPGEIPYDGIYYDPPEEVKYVFRHAQPKRPKSLRIYETHVGMSSPEPKINTYVNFRDEVLPRIKKLGYNAVQIMAIQEHSYYGSFGYHVTNFFAPSSRFGTPEDLKSLIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYPEAVTIGEDVSGMPTFALPVHDGGVGFDYRMHMAVADKWIDLLKQSDETWKMGDIVHTLTNRRWLEKCVTYAESHDQALVGDKTIAFWLMDKDMYDFMALDRPSTPTIDRGIALHKMIRLITMGLGGEGYLNFMGNEFGHPEWIDFPRGPQRLPSGKFIPGNNNSYDKCRRRFDLGDADYLRYHGMQEFDQAMQHLEQKYEFMTSDHQYISRKHEEDKVIVFEKGDLVFVFNFHCNNSYFDYRIGCRKPGVYKVVLDSDAGLFGGFSRIHHAAEHFTADCSHDNRPYSFSVYTPSRTCVVYAPVE

SEQ ID NO: 8410 - protein, 240 aa, Triticum aestivum
MGRGKIVIRRIDNSTSRQVTFSKRRNGIFKKAKELGILCDAEVGLVIFSSTGRLYEYASSSMKSVIDRYGRAKEEQQLVANPNSELKFWQREAASLRQQLHNLQENHRQLTGQDLSGMGVKELQTLENQLEISLRCIRTKKDQILIDEIHELNHKGSLVHQENMELYRKINLIRQENAELQKKLSETEAATEVNRDSRTPYNFAVVEDANVSVDLELNSPQQQNDVEHTAPPKLGLQLHP

SEQ ID NO: 8411 - protein, 283 aa, Zea mays
  misc_feature (122)..(122): Xaa can be any naturally occurring amino acid
  misc_feature (261)..(261): Xaa can be any naturally occurring amino acid
RLAVRGSSGMEWADERAGGAEGLAGYVKVMTDEQMEVLRKQISIYATICEQLVEMHRALTEHQDTIAGIRFSNLYCDPQIIPGGHKITARARWQPTPMQLQILENIFGNQHQCSSASWRTSXDQGNGTPSKQRIKEITAELSHHGQISETNVYNWFQNRRARSKRKQAASLPNNAESEAEVDEESLTDKKPKSDRSLQDNKAMGAHNADRISGMHHLDTDHDQIGGMMYGCNDNGLRSSGSSGQMSFYGNIMPNPRIDHFXGKVESSRSFSHLQHGEGFDMFG

SEQ ID NO: 8412 - protein, 209 aa, Phaseolus lunatus
PESLHMFSFLFDDVGIPQDYRHMDGFGVNTYTLISKAGKPHYVKFHWKATCGEKCLLDEEAVRVGGSNHSHATQDLYDSIAAGNYPEWKLYILTLDPEQEDKFDFDPLDVTKIWPEDVLPLQPVGRMVLNKNIDNFFAENEQLAFCPAIIVPGVYYSDDKLLQTRIFSYADSQRHRLGPNYLQIPANAPKCAHHNNHHEGFMNFMHRDE

SEQ ID NO: 8413 - protein, 368 aa, Yarrowia lipolytica
MTQTHNLFSPIKVGSSELQNRIVLAPLTRTRALPGNVPSDLATEYYAQRAASPGTLLITEATYISPGSAGVPIPGDGIVPGIWSDEQLEAWKKVFKAVHDRGSKIYVQLWDIGRVAWYHKLQELGNYFPTGPSAIPMKGEESEHLKALTHWEIKGKVALYVNAAKNAIAAGADGVEIHSANGYLPDTFLRSASNQRTDEYGGSIENRARFSLEIVDAITEAIGADKTAIRLSPWSTFQDIEVNDTETPAQFTYLFEQLQKRADEGKQLAYVHVVEPRLFGPPEPWATNEPFRKIWKGNFIRAGGYDRETALEDADKSDNTLIAFGRDFIANPDLVQRLKNNEPLAKYDRTTFYVPGAKGYTDYPAYKM

SEQ ID NO: 8414 - protein, 266 aa, Ralstonia metallidurans
MLKVEPIPAFQDNYIWAIHDGHSAAVVDPGEAAPVEQFLAQRGLALGAIVITHHHGDHQGGVSDLLARHPSGPNGEPLPVIGPQGERIGHRTQAVREGDTVTLRHPAVTFRVLDVPGHTAGHVAYVGDLPGAGPVVFCGDTLFASGCGRLFEGTPAQMLASLDKLAALPGDTRVYCAHEYTRSNVRFAQAVEPANPDLAAWAARVDILREAGTPTVPTTVAHERAVNPFLRSRESTVRQAVRAQGGDVSGDAAAFGALRGWKDGFR

SEQ ID NO: 8415 - protein, 451 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGV

SEQ ID NO: 8416 - protein, 542 aa, Streptomyces avermitilis
MAKILKFDEDARRALERGVNKLADTVKVTIGPKGRNVVIDKKFGAPTITNDGVTIAREVEVEDPYENLGAQLVKEVATKTNDIAGDGTTTATVLAQALVREGLKNVAAGASPALLKKGIDAAVKAVSEELLATARPIDEKSDIAAVAGLSAQDSQVGELIAEAMDKVGKDGVITVEESNTFGLELDFTEGMAFDKGYLSPYFVTDQERMEAVLEDPYILIHQGKISSIQDLLPLLEKVIQANASKPLLIIAEDVEGEALSTLVVNKIRGTFNAVAVKAPGFGDRRKAMLGDIATLTGGQVIAEEVGLKLDQVGLDVLGTARRVTVTKDDTTIVDGGGSSDEVAGRINQIKAEIENTDSDWDREKLQERLAKLAGGVCVIKVGAATEVELKEKKHRLEDAISATRAAVEEGIVSGGGSALVHAVKVLEGNLGKTGDEATGVAVVRRAAVEPLRWIAENAGLEGYVITSKVAELDKGQGFNAATGEYGDLVKSGVIDPVKVTRSALENAASIASLLLTTETLVVEKPAEEEADAGHGHGHGHSH

SEQ ID NO: 8417 - protein, 514 aa, Aspergillus oryzae
MVHLAQVHRNADLDSTIKRVDSIQLENTDEDGFYSSVYGTRFATEQLPQTEMPEREMPREVAYRMIKDELSLDGNPMLNLASFVTTYMEDEAEKLMTESFSKNFIDYEEYPQSAEIQNRCVNMIARLFNAPVHSEDEHPMGTSTIGSSEAIMLGTLAMKRRWQNKRKAEGKDYSRPNIVMNSAVQVCWEKAARYFDVEERYVYCTEDRYVIDPQQAVDLVDENTIGICAILGTTYTGEYEDVKAINDLLIERNIDVPIHVDAASGGFVAPFINPKLEWDFRLPKVVSINVSGHKYGLVYPGVGWVVWRSPEYLPKDLIFNINYLGAEQASFTLNFSKGASQVIGQYYQMIRLGKRGYRSIMTNITVTADFLAQELEKMGFIIMSQRRGHGLPLVAFRLPAEREGQFDEFALAHQLRERGWIVPAYTMAPNSNNLKLMRVVVREDFTKSRCDALLSDIKLGLKTLGDMDKAMLDKYTQHVRTHATHSHKSKHNHPHYKGETHSLQGKHGKTHGVC

SEQ ID NO: 8418 - protein, 268 aa, Bifidobacterium longum
MLNNGTVIPQVGLGVFQTPDGDTTVNAVQTALENGYRHIDTAMIYHNEASVGEGIRRAGVPRSDFFLTTKLWNDDIRARCGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 8419 - protein, 484 aa, Arabidopsis thaliana
  misc_feature (103)..(103): Xaa can be any naturally occurring amino acid
  misc_feature (132)..(132): Xaa can be any naturally occurring amino acid
  misc_feature (154)..(154): Xaa can be any naturally occurring amino acid
  misc_feature (159)..(159): Xaa can be any naturally occurring amino acid
  misc_feature (246)..(246): Xaa can be any naturally occurring amino acid
  misc_feature (420)..(420): Xaa can be any naturally occurring amino acid
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTXGTHHAVLSSYGYGSQGLRQYNLGNMMDGXYIAPAFMASFFVQYQDFLTLPXIKVPXLGFGGKGQGKSFPCELVMAKMGINPIMMSAGELESGNAGEPAKLIRQRYREAADLIKKGKMCCLFINDLDAGAGRMGGTTQYTVNNXDNPTNVQLPGMYNKEENARVPIICTGNDFSTLYAPLIRDGRMEKFYWAPTREDPIGVCQGIFRTDKIKDEDIVTLVDQFPGQSIDFFGALRARVYDDEVRKFVESLGVEKIGKRLVNSREGPPVFEQPEMTYEKLMEYGNMLVMEQENAKRAQLVETYLTRPALGDPNADAIGXVATPHRKGAQLAQPAATEGCPGPAAETHAPRPLAPIVLGPHSLSLSPVFSTSRPHLYALPPPPP

SEQ ID NO: 8420 - protein, 682 aa, Gloeobacter violaceus
MQHPNRLSSLLPSLDQAMETRVKLVTPDTVLSDIVEWMGGQADYRCALPERKDRTLRQSGELQPDCVLVAEGAHLVGIITEGDIVRLTALGKDLAAVRAGEVMLGGVVTLVQDGRQDILGALDLMRRHNVRHLPVLDDGGRVTGLLSAGGIRRTLQPIHLLTLRSVAEVMTTPVVHAPAGSLLVNLARLMAGRRVSCVVIAEPHTDGVHVRPVGLITESDIVQFRYLQFDLTQTRAAAVMSAVASPLKPFESVLVAHQQMLRRRVRRLVVTGERGELVGIVTQTGLLRLLDPLEIFGVIEALQRSVHQLEAEKMELLQGRTLQLERLVEERTAQVQEQARREQLARAAAESARQEAEEANRIKDEFLATLSHELRTPLNPIIGFTQLLRKGQLDEASAARALETIERNARAQSRIIEDMLDLSRIITGKLRLEVRPVALATVVEDALDTVRFAAQSKNIELRARLDPNVVLPFGDSNRLRQVVWNLLSNAIKFTPENGSIEVQLERGRAEAVLTVRDSGVGIAGDFLPHVFERFRQANSTTTRSHGGLGLGLAIVRQLVELHGGTVGVESPGSDQGATFTVRLPLLLGRGARTSATQAPLPPEAMGLQVITVETGCLLDGHTLAETDLRRRYGVVVHALRREGRLIGFPDADTPLREGDQLLVSGGCDQLERLKQRMAESQG

SEQ ID NO: 8421 - protein, 249 aa, Zea mays
LQGLGAMGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 8422 - protein, 324 aa, Arabidopsis thaliana
MQTISKASSATSFFRCSRKLSSQPCVRQLNIRKSLVCRVMKLVSSPLRTLRGAGKSIRVSKFCSVSNVSSLQIELVPCLKDNYAYILHDEDTGTVGVVDPSEAEPIIDSLKRSGRNLTYILNTHHHYDHTGGNLELKDRYGAKVIGSAMDKDRIPGIDMALKDGDKWMFAGHEVHVMDTPGHTKGHISLYFPGSRAIFTGDTMFSLSCGKLFEGTPKQMLASLQKITSLPDDTSIYCGHEYTLSNSKFALSLEPNNEVLQSYAAHVAELRSKKLPTIPTTVKMEKACNPFLRSSNTDIRRALRIPEAADEAEALGIIRKAKDDF

SEQ ID NO: 8423 - protein, 612 aa, Streptomyces rimosus
MCGIAGWIDFERNLAQERATAWAMTDTMACRGPDDAGLWTGGHAALGHRRLAVIDPAHGRQPMHSTLPDGTSHVITFSGEIYNFRELRVELESQGHRFRTHCDTEVVLHGYTRWGRELVDRLNGMYAFAVWDEARQELLLVRDRMGVKPLYYHPTATGVLFGSEPKAVLAHPSLRRRVTAEGLCEVLDMVKTPGRTVFSGMREVLPGEMVTVGRSGVARRRYWTLQAREHTDDLETTIATVRGLLTDRVRRQLVSDVPLCTLLSGGLDSSAVTALAARAGDGPVRTFSVDFSGAGTRFQPDAVRGNTDAPYVQEMVRHVAADHTEVVLDSADLAAPEVRAAVLGATDLPPAFWGDMWPSLYLFFRQVRQHCTVALSGEAADELFGGYRWFHRTAAIDAGTFPWLTAGSARYFGGRGLFDRKLLDKLDLPGYQRDRYAEARKEVPVLPGEDAREAELRRVTYLNLTRFVQTLLDRKDRMSMATGLEVRVPFCDHRLVDYVFNVPWAMKSFDGREKSLLRAAVRDLLPESVVTRVKTPYPATQDPVYERLLRDELAALLADSQAPVRELLDLGRARDLLRRPVGAVSQPYDRGSLELVLWMNTWLAEYGVSLEL

SEQ ID NO: 8424 - protein, 221 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 8425 - protein, 283 aa, Pediococcus pentosaceus
MNNLTDTYTLNNGVKIPVVGFGTWQSKDGDEAYNAVKAALEAGYRHIDTAAAYGNEESVGKAIKDSGIDRKELFITSKLWNRDHGYESAKKALDTSLAKLGTDYLDLYLIHWPNPVQFRDEWQQRNADSWRAMEEALDAGKVRAIGVSNFRAHHLDELLKTAKVTPAVNQIFLNPSDTEDEVVAYNKEHGILSEAYSPLGTGKIFTIPELKDIAAKYNKSVAQVVLRWSLQHGFLPLPKSVHADRIKQNTEIFDFELSDDDIKKIDGFHGVAGLAQDPDATDF

SEQ ID NO: 8426 - protein, 501 aa, Zea mays
  misc_feature (109)..(109): Xaa can be any naturally occurring amino acid
ENPPHRRGGPGGRAGMAYAARRKKRLGRYEVGRTIGQGTFAKVKFAVDSDTGAPVAMNVLDKETIFAHRMLHLIKREISHNRPSRRRRWSTTRSSSCRTPKANARSAGXKIKREISIMKIVRHPNIVRLNEVLAGRTKIYIVLELVTGGELFDRIVRHGKLRENEARKYFQQLIDAIDYCHSKGVYHRDLKPQNLLLDSRGNLKLSDFGLSTLSQNGVGLVHTTCGTPNYVAPEVLSSNGYDGSAADIWSCGVILYVLMAGYLPFEENDLPHLYEKITAAQYSCPYWFSPGAKSLIQRILDPNPRTRITIEEIREDPWFKKNYVTIRCGEDENVSLDDVQAIFDNIEDKYVSDEVTHKDGGPLMMNAFEMIALSQGLDLSALFDRQQEFVKRQTRFVSRKPAKTVVATIEVVAESMGLKVHSRNYKVRLEGPASNRASQFAVVLEVFEVAPSLFMVDVRKVAGDTPEYHRFYENLCSKLCSIIWRPTEVSAKSTPLRTTTC

SEQ ID NO: 8427 - protein, 532 aa, Bacillus licheniformis
MDQHSNEQKSDMETDDTLTNRQGHPITNNQNIRTVGNRGPSTLENYDFLEKISHFDRERVPERVVHARGAGAHGYFEAYGTAGDEPVSKYTRAKLFQEKGKRTPVFVRFSTVTHGISSPETLRDPRGFAVKFYTEDGNWDLVGNNLKIFFIRDAVKFPDLIHAFKPDPVTNLQDGERIFDFISNTPEAMHMITFLFSPWGIPANYRQMQGSGVNTYKWVNQEGEAVLVKYHWEPKQGIKNLTQKEAEEIQAKNFNHATQDLYEAIERGDYPEWELFVQIMSDDEHPELDFDPLDDTKLWPEDQFPWLPVGKMVLNKNPEDYFTEVEQAAFGTGVLVDGLDFSDDKMLQGRTFSYSDTQRYRVGANYLQLPINAPKKRVATNQRGGQMQYKVDLGKNQSPHINYEPSTINGLKEAKQDGKEYTPHVEGNLVRESIDRQNNFKQAGDTYRHFEDWEKDELITNLVNTLAPCDQRIQTKMIDMLKQCDKEYGSRVEEGLKNASSQNTSSREPIGAEGAEDAPRQAEEKGHSQDPY

SEQ ID NO: 8428 - protein, 274 aa, Listeria monocytogenes
MNLKYTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 8429 - protein, 154 aa, Streptococcus thermophilus
MLNKIQQRNSDIYSMTPFNFFEDFRRNLFNDFFEDFSHNLFNDLKSNLIKTDIHETDNEYVVEAELPGIPKEDIQVNYENGVLTISGQRQIDAAIEDKKGKLIHSERSLTSVRRQYLLENVKEDEIKASYSDGILKVTLPKDSNKEIKTSIPIE

SEQ ID NO: 8430 - protein, 695 aa, Haemophilus influenzae
MVMKFKMSKNVICYAWLSVCLSSAIPAFAVQPTLKPSDISIPAISEESQLATKRATTRLTQSHYRKIKLDDDFSEKIFDRYIKNLDFSHNTFLQSDIDELRQKYGTKLDEQLNQGDLSAAFDIYDVMMKRRYERYTYALSLLDKEPDLNGQDQIEIDREKAAAPQTEADANKLWDARVKNDIINLKLKDKKWSEIKAKLTKRYNLAIRRLTQTKADDIVQIYLNAFAREIDPHTSYLSPRTAKSFNESINLSLEGIGTTLQLEDDEISIKSLVPGAPAERSKKLHPGDKIIGVGQATGDIEDVVGWRLEDLVEKIKGKKGTKVRLEIEPAKGGKSRIITLVRDKVRIEDQAAKLTFEKVSGKNIAVIKIPSFYIGLTEDVKKLLVKLENQKAEALIVDLRENGGGALTEAVALSGLFIADGPVVQVRDAYQRIRVHEDDDATQQYKGLLFVMINRYSASASEIFAAAMQDYRRGIIIGQNTFGKGTVQQSRSLNFIYDLDQSPLGVLQYTIQKFYRVNGGSTQLKGVAADINFPEIIDAKEYGEDKEDNALAWDKIPSASYMEVGNIDYIDNAVNILNEKHLARIAKDPEFVALNEELKVRNERRDRKFLSLNYKMRKAENDKDDARRLKDLNERFKREGKKALKDIDDLPKDYEAPDFFLKEAEKIAADFVIFNSDQKINQANGLSEAKTESKK

SEQ ID NO: 8431 - protein, 221 aa, Glycine max
MGQQSLIYSFVARGTVILAEYTEFTGNFTSVAAQCLQKLPSSNNKFTYNCDGHTFNYLVDNGFTYCVVAVESAGRQIPIAFLERIKEDFTKKYAGGKAATAAAHSLNREFGPKLKEEMQYCVDHPEEISKLAKVKAQVSEVKGVMMENIEKVLDRGEKIELLVDKTENLRSQAQDFRQQGTKIRRKMWFQNMKIKLIVLGIIIALILIIVLSVCGGFNCGK

SEQ ID NO: 8432 - protein, 365 aa, Rhodospirillum rubrum
MSSPFPHLFDPLALGDLHLPNRIVLAPLTRSRALPGEVAGALTARYYAQRASGGLLISEGTQISPSGRGYPRTPGIHSPEQIAGWKGVTEAVHAAGGRIFAQLWHVGRISHRSLQPGGVLPVAPSAIRPKTKIFTESGLVALETPRALDTAEMADIVASFRAAAENARAAGFDGVEIHAANGYLLDQFLRDGTNHRDDAYGGSIDNRLRLVLEVVEAVLGVWDKARVGLRLSPANPFNDILDSTPQATFEAVVSALDGFGLGYLHMVEGSLGSGEGAPEIDFAALRRLWQGVYMANGGYDGPRAEAALASGHAQLVSFGTAYLANPDLPERLRTNAPLNTPDSTTFYQGEDKGYVDYPTLADGAA

SEQ ID NO: 8433 - protein, 587 aa, Glycine max
  misc_feature (121)..(121): Xaa can be any naturally occurring amino acid
MYRFATSLASKARIARSSTQQIGSRVSWNRNYAAKDIKFGVEARALMLKGVEELADAVKVTMGPKGRNVVIEQSFGAPKVTKDGVTVAKSIEFKDKVKNVGASLVKQVANATNDVAGDEYXGREHFNCLAGTTCATVLTRAIFTEGCKSIAAGMNAMDLRRGISMAVDAVVTNLKSRARMISTSEEIAQVGMISANGEREIGELIAKAMEKVGKEGVITISDGKTLYNELEVVEGMKLDRGYISPYFITNDKNQKCELEDPLIIIHEKKISSINAIVKVLELALKRQRSLLIIAEDVESDALATLILNKLRAGIKVCAIKAPGFGENRKSGLQDLAVLTGGQLITEELGLKLEKVDLDMLGTCKKITVSKDDTVILDGAGDKKALEERCEQIRSAIENSTSDYDKEKLQERLAKLSGGVAVLKIGGASEAEVGEKKDRVTDALNATKAAVEEGIVPGGGVALLYASSELDKLQTANFDQKIGVQIIQNALKTPVHTIASNAGVEGAVVVGKLLEQNDPDLGYDAAKGEYVDMVKAGIIDPLKVIRTALVDAASVSSLMTTTEAVVSELPNDNKDTPAMAGGMGGMGY

SEQ ID NO: 8434 - protein, 196 aa, Zea mays
VLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKSLEGAFVLNQHQPAEHDESSSQTDVTV

SEQ ID NO: 8435 - protein, 431 aa, Arabidopsis thaliana
MAEDSNSSESIIVNVTGDDNKSALFGKYDLGKLLGSGAFAKVYQAEDLQNGGESVAIKVVQKKRLKDGLTAHVKREISVMRRLRHPHIVLLSEVLATKTKIYFVMELAKGGELFSRVTSNRFTESLSRKYFRQLISAVRYCHARGVFHRDLKPENLLLDENRDLKVSDFGLSAMKEQIHPDGMLHTLCGTPAYVAPELLLKKGYDGSKADIWSCGVVLFLLNAGYLPFRDPNIMGLYRKIHKAQYKLPDWTSSDLRKLLRRLLEPNPELRITVEEILKDPWFNHGVDPSEIIGIQADDYDLEENGKILNAFDLISSASSSNLSGLFGNFVTPDHCDQFVSDESTAVIMRKVEEVAKQLNLRIAKKKERAIKLEGPHGVANVVVKVRRLTNELVMVEMKNKQRDVGLVWADALRQKLRRLINQPVYKVPDKP

SEQ ID NO: 8436 - protein, 546 aa, Cryptococcus neoformans
MPVFSTLINSTESYQRRFDQMARAVLVYWVLKYVLLDGFRHIKARGLCGTANEIRNKIKSLVVRIMLAFPSNRAKLNSELAKTRAELKEKLAPSQYPDGVRLTTVRTLPETGRGREWLESEWENLKKLEKADVDNGRVSGAVYHGGDELNAVINEAMAKFVVTNPLHPDVFPGVRKMESEIVSMCLNLFNGPNGAGTTTSGGTESILMSVKTHRDWARVTKGITRPEMVIPSSAHAAFWKASEYFNIKLHVIPVNQKTRKAEVTAMKRAINPNTIMIVGSAPNFPDGAIDPIPELGALAKRRNVGLHVDCCLGSFIMPFLEKAGFSEGIDPFDFRVPGVTSISCDTHKYAFCPKGTSVIMYRSSELRRFQYYVITDWAGGVYASPSMAGSRPGSVLAGAWAVLNHIGADGYTSSCRQIISAARYLTSSLRTLFPDDLYVLGDPKGPVVAFNSKTINIYAVGDVMSKKGWHLSALGGDGGLHMAFTRLSAKSVDKLIEDLGDALKEVKASPQGAGGDMVALYGLGQTSAGPHVVGKLAETFLDTLYE

SEQ ID NO: 8437 - protein, 201 aa, Clostridium tetani
MELKRIPVGMYQANCYILMDKKSKEGIIVDPGDEANLILQTVNKMDCKVKYILLTHGHVDHVSAVKEVKDSLKAPVGINEKDEESILKGMDLFGNSQTCGAADIKIKEGDTFKIGDKEIKCIETPGHSLGGMCFLIENIIFTGDTLFEGSIGRTDFYGGNFEILIKNIKEKILTIPEDTLVLPGHGMETTVGKEKISNPFL

SEQ ID NO: 8438 - protein, 485 aa, Bacillus licheniformis
MTTNKNNLTTSWGAPVGDNQNSMTAGSRGPTLIQDVHLLEKLAHFNRERVPERVVHAKGAGAHGYFEVTNDVSKYTKAKFLSEVGKRTPLFVRFSTVAGENGSADSVRDPRGFAVKFYTEEGNYDLVGNNTPVFFIRDAIKFPDFIHTQKRHPVTHLKNPDAVWDFWSLSPESLHQVTILMSDRGIPATYRHMHGFGSHTFKWVNAEGEGVWIKYHFKTEQGIKNLTEEVGTKIAGENPDYHTQDLYEAIEKGDFPAWKLYVQIMPLEDADTYRFDPFDVTKVWSQKDYPLIEVGRMVLNRNPENYFAEVEQATFSPGTLVPGIEPSPDKMLQGRLFAYADAHRYRVGANHNSLPINRPKAEVHNYQRDGQMRFDSNGGGSVYYEPNSFGGPQETPENKTTAYPVSGSADSTAYDHNDHYTQAGDLYRLLSEEERTRLVSNIVGSMKQVTKDEIKLRQIQHFYKADPEYGTRVAEGLGLSVPQEV

SEQ ID NO: 8439 - protein, 918 aa, Salmonella enterica
MTNYSLRARMMILILAPTVLIGLLLSIFFVVHRYNDLQRQLEDAGASIIEPLAVSSEYGMNLQNRESIGQLISVLHRRHSDIVRAISVYDDHNRLFVTSNFHLDPSQMQLPAGAPFPRRLSVDRHGDIMILRTPIISESYSPDESAIADAKNTKNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELNPTQRDHLNTIERSANNLLAIINDVLDFSKLEAGKLILESIPFPLRNTLDEVVTLLAHSSHDKGLELTLNIKNDVPENVIGDPLRLQQVITNLVGNAIKFTESGNIDILVEKRALSNTKVQIEVQIRDTGIGIPERDQSRLFQAFRQADASISRRHGGTGLGLVITQKLVNEMGGDISFHSQPNRGSTFWFHINLDLNPNVIIDGPSTACLAGKRLAYIEPNATAAQCTLDLLSDTPVEVIYSPTFSALPLAHYDIMILSVPVTFREPLTMQHERLAKAASMTDFLLLALPCHAQINAEKLKQGGAAACLLKPLTSTRLLPALTEYCQLNHHPEPLLMDTSKITMTVMAVDDNPANLKLIGALLEDKVQHVELCDSGHQAVDRAKQMQFDLILMDIQMPDMDGIRACELIHQLPHQQQTPVIAVTAHAMAGQKEKLLSAGMNDYLAKPIEEEKLHNLLLRYKPGANVAARLMAPEPAEFIFNPNATLDWQLALRQAAGKPDLARDMLQMLIDFLPEVRNKIEEQLVGENPNGLVDLVHKLHGSCGYSGVPRMKNLCQLIEQQLRSGVHEEELEPEFLELLDEMDNVAREAKKILG

SEQ ID NO: 8440 - protein, 666 aa, Photobacterium profundum
MNCRFRFSLIAAGMMLAASAQALEAKYSLSDLPQLAPEKQHATASKRVASRFTRSHYKQFSLNDQFSSDMFDRYVEMLDFNKSFLTAADVRLLEKWQNKFDDQLKVGDTSGAFEIFNKVLQRRYDRYQYALTLLDNEIKFNTNDDFVVDRSELDWAADRNALNEIWRQRVKYDALNLKLADKDWKEIKETLSKRYNNALKRLTQTHSEDVFQIYMNAFAREVDPHTSYLSPRNAEQFQSEMNLSLEGIGAVLQVVDDYTVIRSLVAGGPASSSKKLAAGDRIIGVAQDGKSVVDVIGWRLDDVVQLIKGPKGSKVKLEILPEGKNAKSYDITIVRDKIRLEDRAVKSEVKTVGSKKIGVIEVPSFYVGLAEDTKKEIAKLNESQVDGVVIDLRNNGGGALTEATALTGLFINSGPVVQVRDSYGRVKVNGDSDDRVYFDGPLTVLQNRYSASASEIFAAATQDYGRAVVIGEQSFGKGTVQQHRSLNHIYDLFDKPLGHVQYTIQKFYRINGGSTQNLGVVPDIAFPTAVDPAETGESVEDNALPWDSIKPASYQKLVNYSPILPSLKAKHEQRISKDMEFGFIRDDIQEYKKDKDIKTISLNEKMRIAEQDKTDSKRLARLNKRQKVLGKKPFATLEDVPKDYESPDAYLDEAVDITADLVNAQS

SEQ ID NO: 8441 - protein, 437 aa, Glycine max
MEPPSQQKSPQPPPRTATILGKYQLTRFLGRGSFAKVYQGRSLVDGSAVAVKIIDKSKTVDAGMEPRIIREIDAMRRLHHHPNILKIHEVLATKTKIHLVVELAAGGELFAKISRRGKLPESTARRYFQQLVSALRFCHRNGVAHRDLKPQNLLLDGDGNLKVSDFGLSALPEQLKNGLLHTACGTPAYTAPEILRRSGGYDGSKADAWSCGLILFVFLAGHLPFDDTNIPAMCKKISRRDYQFPEWISKPARFVIHKLLDPNPETRISLESLFGNAWFKKSLNPETAEENALGLSYVKSSYNYEGSKKSSGVTAFDIISMSSGLDLTRLFETTSDLGSKREKRFSSSARVEVVEEKVKEVGGVLGFKIEVGKSNGAIALVKGKVALVFEVLEIVPHELLFVAVKVVEGALEFEEHHWGDWKDALQDLVLSWHNQES

SEQ ID NO: 8442 - protein, 270 aa, Secale cereale
ERIPERVVHARGASAKGFFEVPHDVSQLTCADFLGAPGVQTPVIVRFSTVVHDRGSPETLRDPRGFAVKFYTREGNFDLVGNNMPVFFIRDGMKFPDMVHAFKPSPKTNMQENWRIVDFSSHHPESLHMFTFLFDDVRIPLNYRHMDGFGVNTYTFISSDGKAHLVKFHWKPTCGVKCLLDDDAVTVGGTCHTHATKDLTDSIAAGNYPVWKVFIQTVDADHEDKFDFDPLDVTKTWPEDIIQLQPVGRMVLNKNIDNFFAENEQLAFCS

SEQ ID NO: 8443 - protein, 237 aa, Arabidopsis thaliana
  misc_feature (117)..(117): Xaa can be any naturally occurring amino acid
TTACGTPDFDKMMGNLICKQMPWNDEHAMFAAWMDCKTEDPWIDAIMVLLLKFGLMHHLALHCVACFLTRGDLFIHWEQGRDVFERLLIDSDWAINNGNWMWLSCSSFFYQELSPFXFNRIYSPISFGKKYDPDGKYIRHFLPVLKDMPKQYIYEPWTAPLSVQTKANCIVGKDYPKPMVLHDSASKECKRKMGEAYALNKKMDGKVDEENLRDLRRKLQKDEHEESKIRNQRPTLK

SEQ ID NO: 8444 - protein, 358 aa, Unknown
  Polaromonas sp. JS666
MSRLFSKTTLGSLPLQNHLLMSPLTRNRATGNIPNALMAQYYAQRATAGLIISEGTSPSPNGLGYPRIPGIFSAEQIAGWKQITDAVHAQGGKMFMQLMHCGRIAHPLNLPQGARVLGPSAVAAAGDMYTDAEGLKPNALPQAMTEADIKTAIEEFAQGAKNAVAAGFDGVELHGANGYLLEQFIRPNSNQRTDGYGGAIENRARFVLEVADAVIEAIGKDKVGIRLSPFGVFNDMPLYDAMQADYTWLAQQLNARGVVYIHLVDHSAMGAPTVPDAMKAAFRQLFKGTLVLSGGYDAACAEGDLVAGKADLVAVGRPFLANPDLIARWQAGAAVNAPDMSTFYTPGPEGYTDYPTLA

SEQ ID NO: 8445 - protein, 497 aa, Ustilago maydis
MFKSFGKIMGGSSRKGKSKLQDGDDSVDASNGLPGSDSSNLLRAKSKDSLAVTENGSGNFANNGSSAPAKIEKRGGVSRHESPLPSPSPSARNVLEGQEESSEVGSSAVARSAPASDVGGPRPANDAASQSTSVPTANTILSNPLAQSGSTGFPSSVGKNAQAAAGGDQVRTFDIDDMISRLLEAGYSGKIPKPALKNAEITAVCQAAREIFLSQPTLIELSPPVKIVGDTHGQYHDLLRLFEMCGFPPSANYLFLGDYVDRGKQSLETILLLLCYKIKYPENFFLLRGNHECANVTRVYGFYDECKRRVNIKIWKTFIDVFNTLPIAAVVASKIFCVHGGLSPSLSNMDDIRRIERPTDVPDYGLLNDLLWSDPSDTALDWEDNERGVSYCFGKAVIQQFLAQYDFDLICRAHMVVEDGYEFWNERTLVTIFSAPNYCGEFDNFGAVMSVSEDLLCAFELLKPLDGAALKKEMAKNKRRSLLQHQSPPARGSQQSY

SEQ ID NO: 8446 - protein, 485 aa, Glycine max
MLREKRESALKMGKFSSSYSTSDFVHFGVLLPFLLLSQLFFQLAWCGSIVKFLPGLEGPLPFVLETGYVGVGESEDVQAFYYFIESENNPKEDPLMLWLTGGPGCSAFSGLVIEIGPIAFKNEEYNGSLPNLVLRPHSWTKVSSIIFVDLPVSTGFTYATTEFATQRSDWIQVHQVHQFLRKWLIEHPNFLSTDVYIGGDSYSGITIPAIVQEISLGNEKGLQPWINLQGYLLGNPATTRRHENYRISFAHGMGLISDELYRSLQKNCKGEYINVDTKNVLCSRNIETFNEVTSGLSMVNILDPSCDWLDTETSWRRSLLKKYPRKNFLNTHLKLPSLNCRSYAYFLCGYWANDDSVRSALHIRKGTIGKWRRCTFNIPNKEDISSSYEYHVNLSRKGYRSLIYSGDHDMKIPFLETQAWISSLNYSIVDDWRQWHTDGQVAGYTRTYSNRMTFATVKGGGHTAPEYKPEECLAMFRRWISNKAL

SEQ ID NO: 8447 - protein, 224 aa, Aristida purpurea
IENKISRQVTFAKRRNGLLKKAYELSLLCDAEVALIIFSGRGRLFEFSSSSCMYKTLERYRSCNYNPQEAKAPQESEINYQEYLKLKTRVEFLQTTQRNILGEDLGPLSMKELVQLENQIEISLKQIRSRKNQMLLDQHYDLKNKEQKLQDLNKDLRKKLQETSGENALHISWEEGGHSGASGNAIEPNQGFLQHPENDSSLQIGYHQQAYMDQLSNEDMGAHH

SEQ ID NO: 8448 - protein, 547 aa, Pseudomonas aeruginosa
MAAKEVKFGDSARKKMLVGVNVLADAVKATLGPKGRNVVLDKSFGAPTITKDGVSVAKEIELKDKFENMGAQLVKDVASRPTDAAGDGTTTATVLAQAIVNEGLKAVAAGMNPMDLKRGIDKATVAIVAQLKELAKPCADTKAIAQVGTISANSDESIGQIIAEAMEKVGKEGVITVEEGSGLENELSVVEGMQFDRGYLSPYFVNKPDTMAAELDSPLLLLVDKKISNIREMLPVLEAVAKAGRPLLIVAEDVEGEALATLVVNNMRGIVKVAAVKAPGFGDRRKAMLQDIAILTGGTVISEEVGLSLEGATLEHLGNAKRVVINKENTTIIDGAGVQADIEARVLQIRKQIEETTSDYDREKLQERLAKLAGGVAVIKVGAATEVEMKEKKAPVEDALHATRAAVEEGVVPGGGVALVRALQAIEGLKGDNEEQNVGIALLRRAVESPVRQIVANAGDEPSVVVDKVKQGSGNYGFNAATGVYGDMIEMGILDPAKVTRSALQAAASIGGLMITTEAMVAEIVEDKPAMGGMPDMGGMGGMGGMM

SEQ ID NO: 8449 - protein, 925 aa, Pseudomonas fluorescens
MRWLRIAIGFTVTLLTLLCMLPAQAAQGSGWSVLLDDQGNLQLSDIRSARYTNQFSPIELDRLTAAEPDGALWLRFRLAPGKHEQVLRIFAPDLSHLNLYVLDGDRLIEQRDTGTAQPQAERPLPSSDFMLPLPQSDKPLDVYLRLVSDHQLRPYITLQAAVMAAANHNQTLIYGLLFGCLAMLILHNLIRYAYTRSRSSLWLAVCEGLLSLSLLLLLNLAGPWLPNWHAIQTPGAYLALLLTAPAGLMFAYRFFAPLGPHPLNKLLIGDILFIVICSLLLLFVNTLPLNIITYALVALAGLSMLLVGFYHWQKGYRPARLFVAAMVVFNIGTLIILPALLGLTLVAPQGLIMTLMGFICISGLLMSIALGERQRSITESRFSISRDLAASNAEINAKAEFLAKISHEIRTPMNGVLGMTELLLGTPLSVKQRDYVQTIHSAGNELLTLINEILDISRLESGQIELDDVQFDLNALIDDCLSIYRAKAEQQNVELISFIQPQVPRVISGDPTRLRQTLLSLLENALKKTEEGEVLVVVALDERSAGPRLRIAVQDSGQPMDQEERDALMHAELHSKHFLSANRLGGNLGLVIARQLIRLMQGEFGIKSGASQGSTLWLTLPLDPDRLEHPTSDLDSPLQGARVLVVDDNDTCRKVLVQQCSAWGLNVSAVPSGKEALALLRTKAHLRDYFDVVLLDQNMPGMTGMQLAAKIKEDPSLNHDILLIMLTGISNAPSKIIARNSGIKRILAKPVAGYTLKTTLADELNQRNRGQVVFQPQVASPAAPVKVPSDFRILVAEDNTISTKVIRGMLGKLNLQPDTASNGEEALQAMKAQRYDLVLMDCEMPILDGFSATQQLRAWEVGNQRIRTPIVALTAHILAEHKERARQAGMDGHMAKPVELSQLRELIEHWVAQRDQQNRATTQPS

SEQ ID NO: 8450 - protein, 272 aa, Unknown
  Nostoc sp. PCC 7120
MTIATSTKPQINWVNTLFFLGLHIGALFAFIPSNFSWAAVGVALLLYWITGGLGITLGFHRLVTHRSFQTPKWLEYFLVLCGTLACQGGPIEWVGTHRIHHLHSDTDPDPHDSNKGFWWSHIGWLIYHSPSHADVPRFTKDIAEDPVYQFLQKYFIFIQIALGLLLLYLGGWSFVVWGVFFRIVWVYHCTWLVNSATHKFGYRTYDAGDRSTNCWWVAVLVFGEGWHNNHHAFQYSARHGLEWWEVDLTWMTVQLLQILGLATNVKLADKKQ

SEQ ID NO: 8451 - protein, 197 aa, Solanum tuberosum
MRVISKLTLLIISIGCIFQVSSLGADASSLLPLILDQMIGSNPANTFLDPFKVLEQIPFGLENREETTLPLSIARVDWKETAEGHVISIDVPGLKKDDIKIEIEENRVLRVSGERKKEEEKNDEQNHWHCVERSYGKFWRQFRLPENADIDTMKAKLENGVLTISFAKLSADRIKGPKVVSIESKQEGKESSVREEL

SEQ ID NO: 8452 - protein, 449 aa, Oryza sativa
MYRAKRAALSPKVKRRVGKYELGRTIGEGTFAKVRFAKNTENDEPVAIKILDKEKVQKHRLVEQIRREICTMKLVKHPNVVRLFEVMGSKARIFIVLEYVTGGELFEIIATNGRLKEEEARKYFQQLINAVDYCHSRGVYHRDLKLENLLLDASGNLKVSDFGLSALTEQVKADGLLHTTCGTPNYVAPEVIEDRGYDGAAADIWSCGVILYVLLAGFLPFEDDNIIALYKKISEAQFTCPSWFSTGAKKLITRILDPNPTTRITISQILEDPWFKKGYKPPVFDEKYETSFDDVDAAFGDSEDRHVKEETEDQPTSMNAFELISLNQALNLDNLFEAKKEYKRETRFTSQCPPKEIITKIEEAAKPLGFDIQKKNYKMRMENLKAGRKGNLNVATEVFQVAPSLHVVELKKAKGDTLEFQKFYRTLSTQLKDVVWKCDGEVEGNGAAA

SEQ ID NO: 8453 - protein, 712 aa, Dechloromonas aromatica
MTRRPRQAMDGLSSPLWRTTLLKQLCWIVLGLTVSAQAAELAPQPQHQRVVRISAALLGHYHYKPAVLDDALSEAIFERYLKTLDSEKYYFTQSDIDQLSEYRTRLDDAIIEENLQAPFAIFNLYARRAEEHFSYARSLLKGGFRFDQNDRFTFVRDKAEWASSDEALREIWQQRVKNDWLRLKLAGKSDPEIVTALDKRYEQSIRRINRLKSDDAFQMFMNAYTTAIEPHTTYLGPRASADFDISMRLSLTGIGAVLQERNDYTMVREVTPGGPAARSGQLKAGDRIVAVAQGEKGAFVDVVGARLDDTVALIRGAADSVVRLDILPANAGPDAKHRQITLVRKKVDLAQQAAKKAVLDVTDNGSARRIGVITLPAFYDDFEGRRKGDPNFRSATRDVAKLLKELGKEKVDGVVLDLRHNGGGSLKEAIELTGLFIDTGPVVMERNAQGQVFVDGDTTPGTAWDGPLGVLIDGESASASEIFAAAIQDYGRGIVIGEQSYGKGTVQTVLNLDQAVGSEKPALGELRMTIAQFFRINGSTTQVRGVQPDIALPAANDPTLTGEASNDNALPWTHIRAAAYDRVADKGEVIPALLARHVARAANDPEFQRLEETASELQRLRLQTSVSLNEAERRRENESLEKRLSGLARADDGLLDSEREPDTDGKDEKAGNKAKDTRLLAAARIIADEVDLQREKGKPGALERPNQAAINR

SEQ ID NO: 8454 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 8455 - protein, 649 aa, Lactobacillus johnsonii
MCGICAFFDPELKDKDCAIQGMMDTIKHRGPSSDGKYTNDKVALGFRRLSIIDLRGGSQPIFNEDKSRAIIFNGEIYNFKPLRKELIDAGHTFTTKADTEVLLHGYEEWGMDGLLKKVRGMFAFVIWDDNTKTLYGARDFFGIKPMYYSDQNGKLIVGSELKSFLAYPGFKKELNTEAVKPYLMNQYNDLKETFFKGVYRFPAGHWFEYKDGKMKTHQYWDAKYVENSLSFEETLDKINEDLKETVDLYRNADVPVGAFLSEGIDSSYLTSLLDPEDVFSVSFDDSTYNEASKAKALSDLHGWKFFADKVDADEAMRDFPEMQYHMDEPDANPSIIPLWYLCKLARKHVTVALSGEGADELFAGYVNYGMHTHNDVIKVFTAGLKKLPKKSRVRLAHKIKKMPNFPGKVHMYTNLAEPSEFYVGQSVIYDMDYPTIFTSKDANGILRDKYKNDLTVNGIYQEDFKKVKNIDEVKQMQYIDLHHFMLNDIEQKADKISMAHSLELRVPYLDKKIAELANSIPTKYLVNRHDTKYALRKASEKVLPEEWAQRPKLGFPTPIKQWLKEPRFYKQVRALFTEDFVDDIFDQKKIVKLLDDNYKGDGSARRQIWAIYTFLVWYKLFFVDYDETVKKYQHVQPEVAELIESGRLV

SEQ ID NO: 8456 - protein, 137 aa, Brassica napus
  misc_feature (100)..(100): Xaa can be any naturally occurring amino acid
MTTISLRKQNTRLPPEVNRVLYVRNLPFNITSEEMYDIFGKYGAIRQIRIGCHKDTKGTAFVVYEDIYDAQNAVDHLSGFNVANRDTSRLPYLRVQRREXYLIVLYYQHAKMSKKFDQKKSEEEVAKLQEKYGVSVF

SEQ ID NO: 8457 - protein, 245 aa, Pinus radiata
MGRGKVELKRIENKINRQVTFAKRRNGLLKKAYELSVLCDAEVALIIFSNRGKLYEFCSSSSMMKTIEKYQKCSYGSLETNCSINEMQNSYQDYLELKARVEVLQRSQRNLLGEELGPLNSKELEQLEHQLENSLKQIRSAKTQFMFDQLAHLQHKEQMLVEANRELRKKLEESNTRIPLRLGWEAEDHNNISYRRLPTQSQGLIFQPLGGYPNMQIGYNPAGSNELNVSPADQHPNGFIPGWML

SEQ ID NO: 8458 - protein, 187 aa, Nicotiana tabacum
ITSMLYVHHGINMGFTGNYHEYFSEATDVDAVVYLMLANNLIHKIFPDATVIAEDVSGMPGLSRPVSEGGIGFDYRLAMAVPDKWIDYLKNKNGEDWSMKEVTRSLTNRRYTEKCIAYAESHDQSIVGDKTIAFLLMDKEMYSGMSCLTDTSPVVDRGIALHKMIHFFTMALGGEGYLNFMDNEFGH

SEQ ID NO: 8459 - protein, 766 aa, Bdellovibrio bacteriovorus
MKKKLTFVHLFLLNQLVTTLVLLTVLGVYGTHLFIQEQRAIRERMEPASAREVDRINNDFATLEANVQRLKSMVELFDVMPKGTRVEKFRQFASATIAGHSTQFNAWVALGPRLAKEYLGRESYVYVVHRDYSLFASPKYNDPTTFVAEVFTEPGYDKDPDVQWWWMNEKSSGVNYSDFYFDKGYMEKVMFSTTTGIFSNAGKLEAVVGIDTLAGDIAHRLGIFKLGDTGGALVVDEHGRPVLPLIAKDTPVLGFKYLRALNQDEFRAMPKLSQKVFNIQNQRQLQEFPGADGKTYLTYSRPIKGKPWHLVIYQEKGEAYSGLYFRLFFFGFVALVAYVVFTLMVWMTGKYVIAQDKEALARLQDSRDRAEAATRAKSLFLSTMSHEIRTPLNAMLGSAELLNETHLNFEQKELLISLQSAGDTLLSMLNNILDFSKFESGRMQLESREFLLSDLVREVQALISTSVLRKNLQFTFHPPEHDRWIVGDSLRLKQVLMNLLGNAVKFTDRGAIELTVQPYPGSEPGKETIFFEVKDTGIGIAKENLKKVFDEFGQEDSSVTRRFGGTGLGLSISQKIVQLMGGELYCESRQFVGSRFHFSVQMTSRRAELWSARFNLELTPPPQLVRPSSEAGRKSILIVDDMEENHTLLKAYIKRLEYVTTDSAYNGYECLEMWERGHYDMIFMDVQMPKMSGLDTIRKLREIERARGLHRTPVVVISANSFTEDIEKSLMAGADQHCGKPVRKQTVLEIVQKYCSEDIETAPANS

SEQ ID NO: 8460 - protein, 464 aa, Glycine max
MEGASWNSSVCVAPFLSKTYDMVDDPSTDLVVSWGENNNSFVVWNVPQFATDILPNHFKHNNFSSFVRQLNAYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 8461 - protein, 389 aa, Chlamydomonas reinhardtii
MAAMMMRQKVAGAIAGERRSAVAPKMGRAATAPVVVASANASAFKGAAVTARVKASTRAARVQSRRTAVLTQAKIGDSLAEFLVEATPDPKLRHVMMSMAEATRTIAHKVRTASCAGTACVNSFGDEQLAVDMVADKLLFEALKYSHVCKLACSEEVPEPVDMGGEGFCVAFDPLDGSSSSDTNFAVGTIFGVWPGDKLTNITGREQVAAGMGIYGPRTVFCIALKDAPGCHEFLLMDDGKWMHVKETTHIGEGKMFAPGNLRATFDNPAYERLINFYLGEKYTLRYTGGIVPDLFQIIVKEKGVFTNLTSPTTKAKLRILFEVAPLALLIEKAGGASSCDGKAVSALDIPILVCDQRTQICYGSIGEVRRFEEYMYGTSPRFSEKVVA

SEQ ID NO: 8462 - protein, 145 aa, Triticum aestivum
  misc_feature (15)..(15): Xaa can be any naturally occurring amino acid
  misc_feature (89)..(89): Xaa can be any naturally occurring amino acid
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 8463 - protein, 523 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGIGEKHTIQSRISQIRQEIQEATSDYDKEKLNERLAKLSGGVAVLKVGAATEVEMKEKKARVEDALHATRAAVEEGVVAGGGVALVRVAGKISHLSGQNEDQNVGIRVALRAMEAPLRQIVSNSGEEPSVVTNNVKDGKGNYGYNAASDQYGDMIDFGILDPTKVTRSALQYAASVAGLMITTECMVTD

SEQ ID NO: 8464 - protein, 523 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSSYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISNDTTTIIGGIGEKHTIQSRISQIRQEIQEATSDYDKEKLNERLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIGFGILDPTKVTRSALQYAASVAGLMITTECMVTD

SEQ ID NO: 8465 - protein, 189 aa, Dacrydium franklinii
DEHGEVVAEIRRSDLEPYLGLHYPATDIPQASRFLFMQNRVRMICDCSATPVQVIQSEELRQPLCLVGSTLRAPHGCHAQYMANMGSIASLVMAVVINGNDEEGAGTSGRSSMKLWGLVVCHHTSPRAVPFPLRYACEFLMQAFGLQLNMELQLAAQLTEKHILRTQTLLCDMLLRDAPIGIVTQSPSI

SEQ ID NO: 8466 - protein, 434 aa, Geobacter metallireducens
MRNELVTPGAGELTYEIRNIVNVAEKLQKHGVKINWENIGDPIVKGEEIPRWMKEIVANEVMENDTWGYCHTRGVLETREFICGLTNNRGGARITPDDIIFFNGLGDAISTVYGNLRHESRILMPSPTYTTHSIGEAAHAQASPVCYRLDPANNWFPDLEDMENHVRYNPQISGILLINPDNPTGMVFSRETLEKIVAIARKYELFIIADEVYNNITYNGQTTVPISDVIGDVPAIAMKGISKEIPWPGSRCGWIEVYNGAKDDQFRKYINSILSAKMNEVCSTTLPQKCIPAIMKHPEYQTYLQERIRRYEKMSTITFDCLREVPELMVNRTNGAFYMSVAFRDGLLTNGQSLPIENAEVRELVEGLVNAPGVSPDKRFVYYLLASTGICIVPLSSFNTPLQGFRVTLLEKDEAECLRIYQTLAKKIAEYLKS

SEQ ID NO: 8467 - protein, 523 aa, Buchnera aphidicola
  misc_feature (310)..(310): Xaa can be any naturally occurring amino acid
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELXKSTLEDLGQAKRVVISKDTTTIIGGIGEKHTIQSRISQIRQEIQEATSDYDKEKLNERLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITTECMVTD

SEQ ID NO: 8468 - protein, 154 aa, Zea mays
MSLVRRSNVFDPFSMDLWDPFDTMFRSIVPSAVSTNSGTATFASARIDWKETPEAHVFKADLPGVKKEEVKVEVEDGNVLVISGQRSREKEDKDDKWHRVERSSGQFVRRFRLPENAKMDQVKAGLENGVLTVTVPKAEEKKPEVTAMAIEISG

SEQ ID NO: 8469 - protein, 238 aa, Avena sativa
IENKISRQVTFAKRRNGLLKKAYELSLLCDAEDALIIFSGRGRLFEFSSSSCMYKTLERYRTCNYNSQEAAPLVENEINYREYLKLKTRVEFLQSSQRNILGEDLGPLSMKELDQIESQIDVSLKHIRSRKNQVLLDQLFDLKSKEQELQDQNKDLRKKLQEMSCGENAVHMSWQDGGGQSSSSGQAVDPYPGPLQHPEHDSSMQIGYHQTYMEQLBNEDHTASHHPNAQPGSSAGWI

SEQ ID NO: 8470 - protein, 548 aa, Desulfovibrio desulfuricans
MASKEIVFDTKARERLARGVDKLANAVKVTLGPKGRNVVIEKSFGAPVITKDGVSVAKEIELEDKFENMGAQMVKEVASKTSDIAGDGTTTATILAQAIYKEGVKLVAAGRNPMAIKRGVDKAVEALVKELGNLAKPTRDQKEIAQVGTISANSDTTIGNIIAEAMSKVGKEGVITVEEAKGLETTLEVVEGMQFDRGYLSPYFVTDPEKMVCEMDEPLILINEKKISSMKDMLPVLEQVAKMNRPLVIIAEDVDGEALATLVVNKLRGTLQVVAVKAPGFGERRKAMLEDIATLTGGRVISEEMGIKLENATVADLGNAKRIVVDKENTTIVDGAGESEAIKARVKMIRAQIEETSSDYDREKLQERLAKIVGGVAVINVGAATETEMKEKKDRVEDALNATRAAVEEGIVPGGGTALVRCCKVLDDVKPADDDEAAGVTIIRRAIEEPLRQIAANAGFEGSIICEKVKEGKDAFGFNAATGEFEDLIAAGVIDPKKVSRIALQNAASVASLLLTTECAIAEKPKEDAPAAPAMGGMGGMGGMGGMY

SEQ ID NO: 8471 - protein, 192 aa, Dacrydium franklinii
DDHGEVISEIRKSDLEPYLGLHYPATDIPQASRFLFMKNRVRMICDCQAPPIRVVEGKRLPRELNLCGSTLRAPHGCHAQYMSNMGSIASLVIAVIVNEKDEEEGDSEGQHQQKGKRLWGLVVCHHTSPRFVPLPLRYACEFLMQVFGIQLNKEVELAAQTREKHILRTQTLLCDMLLRDAPTGIVTRKPNI

SEQ ID NO: 8472 - protein, 222 aa, Chasmanthium latifolium
IENKISRQVTFAKRRNGLLKKAYELSLLCDAEVALIIFSGRGRLFEFSSSSCMYKTLERYRSSNYNSQEVKAPLDSEINYQEYLKLRTRVEFLQTTQRNILGEDLGPLSMKELEQLENQIEISLKHIRTRKSQVLLDQLFDLKTKEQELEDISKGLRKKLHETSGENALHISWEEGGHSGASGNAVEPYQGFQQHRENESSLQIGYRQQAYMEQLNNEDMED

SEQ ID NO: 8473 - protein, 225 aa, Danthonia spicata
IENKISRQVTFAKRRNGLLKKAYELSLLCDAEVALIIFSGRGRLFEFSSSSCMYKTLERYRTCNFNSQEAKAPLDSEINYQEYLKLKTRVEFLQTTQRNILGEDLGPLSSKELEQLENQIEISLKHIRTRKNQALLDQLFDLKSKEQELQDLNKDLRKKLQETSGENAVHISWEEGGHSGASGNAMEPSQGFLQHPENDSDLHMGYHQQAYMDHLNNEDMAAPHH

SEQ ID NO: 8474 - protein, 189 aa, Dacrydium franklinii
DDHGEVIAEMRRSDLEPYLGLHYPATDIPQAARFLFMKNKVRMICDCRGMPVKMIQSKKLEQPLSLSGSTLRAPHGCHAQYMANMGSVASLVMSVTINDNNGNDEDRENGGSRRLWGLVVCHHTSPRFVPFPVRYACEFLMQVFGIQLNKELELAAQLREKHILRTQTVLCDMLLRDAPVGIVTQNPNI

SEQ ID NO: 8475 - protein, 490 aa, Zea mays
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESETAVGVGTVGSSEAIMLAGLAFKRRWQNKRRAEGKPFDKPNIVTGANVQVCWEKFARYFEVELREVKLRDGYYVMDPEKAVEMVDENTICVAAILGSTLNGEFEDVKLLNDLLQAKNRETRWETPIHVDAASGGFIAPFLYPDLEWDFRLPLVKSINVSGHKYGLVYAGIGWCIWRSKEDLPEELIFHINYLGADQPTFTLNFSKGSSQVIAQYYQLIRHGFEGYRNIMENCHENAMVLKEGLEKTGRFDIVSKDEGVPLVAFSLKDRSRHDEFEISDMLRRFGWIVPAYTMPPDAQHVTVLRVVIREEFSRTLAERLVLDIEKVMYQLDALPSRLPPPPPAAPLLRKKTELETQRSVTEAWKKFVLAKKTNGVC

SEQ ID NO: 8476 - protein, 225 aa, Ehrharta erecta
IENKISRQVTFAKRRNGLLKKAYELSLLCDAEVALIIFSGRGRLFEFSSSSCMYKTLERYRSCNYNSQEAAPENEINYQEYLKLKTRVEFLRTTQRNILGEDLGPLSMKELEQLENQIVVSLKQIRDKKNQALLDQLFELKSKEQELRDLNKDLRKKLQETTGDNVLHMSWQDGGGQHSGSSGLTAEHHQGLLHHQDQGNHSLQIGYHQAYMDHLNNEAEMAGHN

SEQ ID NO: 8477 - protein, 229 aa, Eleusine coracana
LENKISRQVTFAKRRNGLLKKAYELSLLCDAEVALIIFSAGRGRLFEFSSSSCMYKTLERYRTCNFNSHEVKAPLDSKINYQDYLKLKTRVEFLQTTQRNILGEDLGPLSNKELEQLEKQIEISLTQIRSRKNQMLLVQLLDLKSKEQELQDLNKDLRKKCQLKKTCGENATHISWEEGGHSGTSRNANEPNQGFLQHAENNYSSLQIGYYQQAYMDQLNNQDIGAAHN

SEQ ID NO: 8478 - protein, 245 aa, Arabidopsis thaliana
MALETLNSPTTTTTARPLLRYREEMEPENLEQWAKRKRTKRQRFDHGHQNQETNKNLPSEEEYLALCLLMLARGSAVQSPPLPPLPSRASPSDHRDYKCTVCGKSFSSYQALGGHKTSHRKPTNTSITSGNQELSNNSHSNSGSVVINVTVNTGNGVSQSGKIHTCSICFKSFASGQALGGHKRCHYDGGNNGNGNGSSSNSVELVAGSDVSDVDNERWSEESAIGGHRGFDLNLPADQVSVTTS

SEQ ID NO: 8479 - protein, 484 aa, Proteus mirabilis
  misc_feature (53)..(53): Xaa can be any naturally occurring amino acid
MEKKKLTTAAGAPVVDNNNVITAGPRGPMLLQDVWFLEKLAHFDREVIPERRXHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 8480 - protein, 548 aa, Pseudomonas fluorescens
MAAKEVKFGDSARKKMLVGVNVLADAVKATLGPKGRNVILEKSFGAPTITKDGVSVAKEIELEDRFENMGAQLVKDVASRANDDAGDGTTTATVLAQSIVNEGLKAVAAGMNPMDLKRGIDKATIAVVAELKKLSAPCTDTKAIAQVGTISANSDNSIGDIIAEAMEKVGKEGVITVEEGSGLENELSVVEGMQFDRGYLSPYFVNKPDTMVAELEGALILLVDKKISNIREMLPVLEAVAKAGRPLLIVAEDVEGEALATLVVNNMRGIVKVAAVKAPGFGDRRKAMLQDIAVLTGGTVISEEIGLSLESTTLEHLGSAKRVTLSKENTIIVDGAGNDGDIQARIAQIRAQVAETSSDYDREKLQERLAKLSGGVAVIKVGAGSEVEMKEKKARVEDALHATRAAVEEGVVPGGGVALIRALNAIINLKGDNADQDVGIAVLRRAVEAPLRQIAANSGDEPSVVVNEVKNGKGNFGYNAATGEYGDMIEMGILDPTKVTRSALQAASSIGGLILTTEAAVADAPKKDGAAGGGMPDMGGMGGMGGMM

SEQ ID NO: 8481 - protein, 135 aa, Triticum aestivum
MATISSTSYFSSQPQLPASDGANPATTRSSSSNGRQPRRRRTGRCVMLEVDAASGSGSGGAAVGRTRSLTEEDLEELKACLDLGFGFSYHEIPGLRGTLPGLELCYSMTRRFLDEQRTLVGQLEPAAAAAATPIP

SEQ ID NO: 8482 - protein, 765 aa, Saccharophagus degradans
MLLLFQRVRNLPLTAKAYITIVIAAAVAVAWVSAVEWSIATNKHQQHIATATKNARQQLNQAIQTGNQLVLEHCLTNLVAQSIIKRATLIGPSSRQEKTSLNYATSEGFSTLREPLDAGWVLEMQVSTGMTAFLERLVIDLVGILLITGALLLYVRLALVSKLLQLNFAARTLNLENLNRSLLPKKSRQPQKRAADSQDELDSLLQALERIRLSMLEDREQRRTVELALMREKEEKIETRRLVQEAEAANRAKSQFIATMSHEIRTPMNGVIGMVEMLRDTTLDDSQRHYLGIIERSGDSLMNIINDILDYSKIEAGKMSLEHMQFDLEELLEDCVQMFSASTDKRNIELICSISPNTPKQLMGDPTRLKQVLVNLIGNAFKFTSEGHIYVEARQVNASDADLPMIHFSVEDSGIGIESNQQEKLFDAFCQADGSTTRKFGGTGLGLTICKQLAEMMGGEIGVYSREKAGSTFWFSAVFTHVEKAINEQPPQSLAGKKLLVVNQSKIVEKVIASHAADWNIACRIVHSGEKALEVISGQHHYDFIILSQDLQDMPGLDVADKVRTLAAYSSTPIFLVTKVRKSQLPEDRLHTITALLPYPLSIHKIENLLQTKPTHTVVEEQKTNTQATTVSEGPLHVLVAEDNPVNRMVIEGLLAKFDIAPKFAEDGLQALNAVTESPTPYDLIIMDCEMPEMDGFEATRSIRTWESNNNQPATTIIALTAHVEAEHRQRVFDSGMNYYLSKPVTMEKLSEALTTAGLAPQIAS

SEQ ID NO: 8483 - protein, 207 aa, Pennisetum glaucum
MATRRRMLLKVIILGDSGVGKTSLMNQYVNKKFSNQYKATIGADFLTKEVQIDDRLFTLQIWDTAGQERFQSLGVAFYRGADCCVLVYDVNVTKSFEKLNNWREEFLLQASPSDPENFPFVLLGNKIDVDGGNSRTISEKKAKAWCASKGNIPYFETSAKEGFNVEAAFECIARNAIKNEPEDDMYLPDTIDVGGAGRQQRSSGCEC

SEQ ID NO: 8484 - protein, 541 aa, Nocardia farcinica
MAKTIAYDEEARRGLERGLNSLADAVKVTLGPKGRNVVLEKKWGAPTITNDGVSIAKEIELEDPYEKIGAELVKEVAKKTDDVAGDGTTTATVLAQALVREGLRNVAAGANPLGLKRGIEKAVEAVTAKLLDTAKEVETKEQIAATAGISAGDASIGELIAEAMDKVGKEGVITVEESNTFGLQLELTEGMRFDKGYISGYFVTDPERQEAVLEDPYILLVGSKVSTVKDLLPLLEKVIQAGKPLLIIAEDVEGEALSTLVVNKIRGTFKSVAVKAPGFGDRRKAQLADIAILTGGEVISEEVGLSLETAGIELLGQARKVVVTKDETTIVEGAGDAEAIKGRVAQIRTEIENSDSDYDREKLQERLAKLAGGVAVIKAGAATEVELKERKHRIEDAVRNAKAAVEEGIVAGGGVALLQAAPALDELKLTGDEATGANIVRVALSAPLKQIAFNAGLEPGVVAEKVSNLEAGHGLNADSGEYEDLLAAGVADPVKVTRSALQNAASIAALFLTTEAVVADKPEKAAAPAGDPTGGMGGMDF

SEQ ID NO: 8485 - protein, 375 aa, Staphylococcus aureus
MKSKYEPLFDKVELPNGVELRNRFVLAPLTHISSNDDGTISDVELPYIEKRSQDVGITINAASNVSDVGKAFPGQPSIAHDSNIEGLKRLATAMKKNGAKALVQIHHGGAQALPELTPDGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 8486 - protein, 541 aa, Lactobacillus plantarum
MAKELKFSEDARSAMLKGVDQLADTVKSTLGPKGRNVVLEQSYGSPTITNDGVTIAKAIELDDHFENMGAKLVSEVASKTNDIAGDGTTTATVLTQSIVNEGMKNVTAGANPVGIRRGIEEATKTAVDSLHAMAHEVKTQEDIAQIASVSSASEETGKLIAEAMEKVGHDGVITIEESRGVDTSLDVVEGMQFDRGYLSQYMVTDNDKMEADLDNPYILITDKKISNIQDILPLLQSIVEQGKPLLIIADDISGEALPTLVLNKMRGTFNVVAVKAPGFGDRRKEQLQDIAILTGGTVITDDLGLELKDTTIDQLGQANKVTVTKDNTTIVEGAGSKDAISERVEFIRNQIGETTSDFDKEKLQERLAKLAGGVAVVRVGAATETELKERKYRIEDALNATRAAVEEGFVAGGGTALINVIKDVAALKETGDVQTGINIVKRALEEPVRQIAENAGLEGSVIVEKMKEQKPGVGFNAATDEWVDMIKAGIVDPTKVTRSALQNAASVSALLLTTEAVVAEKPEENAPAAPAAPNPGMGGMM

SEQ ID NO: 8487 - protein, 143 aa, Cichorium intybus
MAREKIKIRKIDNITARQVTFSKRRRGLLKKAEELAVLCDADVALVIFSATGKLFEYASSSMQELLGKYKLHSTNNVNKVDEPSLDLQLVESQESRMSQEVLEKDRELSQLRGEDLQGLTLEELQRLESLLEGRLNRVAPDKG

SEQ ID NO: 8488 - protein, 370 aa, Pseudomonas aeruginosa
MLFSPYAFGHLTLPNRIVMPPMTRSRAASGEVATALMAEYYSQRAGAGLIVSEGTQISRQGQGYAWTPGIHSAEQVAGWRQVTDAVHAAGGRIFAQLWHVGRVSHTSLQPGNAAPVSSSALVAEGVKVFVDPQGRGAQAGGGEMVQHSAPRALAVEEIREIVADYAQAARNALDAGFDGVELHGANGYLINQFIDSQANARNDQYGGSLENRLRFLREVAEAVTAVVGRERIGVRLAPLTTLQGAVDDTPQATYLAAARLLDEIGVAYIHIAEADWEDAPAMPAAFKEALRIVYRGSLIYSGMYTKARAEEALAKGWADLIGFGRPFIANPDLPYRLEHDLALADGDRSTYFGGGAAGYTDYPSLPQAAG

SEQ ID NO: 8489 - protein, 693 aa, Pseudomonas syringae
MKQLLPSTALALFVGLGVLPMSASTFAANSWDNLQPDRDEVIASLNVVELLKRHHYSKPPLDDKRSAIIYQSYIKQLDPSRSYFMASDIAEFDKWQFQFDDFLKSGDLNPGFTIYKRYLDRIKARLDFALAELSKGVDKLDFNTKETLLVDRKDAAWPKDTAELDELWRKRIKDEVLRLKIAGKDPAKIQETLTKRYKNQQARLNQTRAEDIFQAYINTFAMSYDPHTNYLSPDSAENFDINMSLSLEGIGAVLQSDNDNVKIVRLVPAGPAAKTKQVAPADKIVAVAQGDKEMVDVIGWRLDEVVKLIRGPKGSVVRLEIIPASNAPNDQTSKIVAITREAVKLEEQAAKKSILHLKQDGKDYKLGVIDIPAFYLDFKAYRAGDPEYKSTTRDVKKLLTELQAEKVDGVVLDLRNNGGGSLQEATELTSLFIDKGPTVLVRNADGKVDVLEDEAKGAFYKGPMALLVNRLSASASEIFAGAMQDYHRALVIGGQTFGKGTVQTIQPLNHGELKLTLAKFYRVSGQSTQHQGVVPDITYPSLIDTKEIGESALPEAMPWDSIKPAIKPAIDPFKPFLAQLQSRHEARSSKDAEFVFIEDRLALAKKLMNEKTVSLNEADRRAEHASIEGKQLALENTRRKAKGEEPLKELKKEDEDALPVEDEKTKPEDDAYLAETGRILIDYLGLSAAVAKK

SEQ ID NO: 8490 - protein, 192 aa, Gnetum gnemon
DDHGEVISEIRRSDLEPYLGLHYPATDIPQASRFLFLRNRVRMICDCYAQPVKVIQDKKLSKDLSFCGSTLRAPHGCHSQYMANMGSVASLVLAVIVNEREEEEGDSENQVEQKGRKLWGLVVCHHTSPRFVPFPMRYACEFMMQVFSIQLNKEVELAFQVREKHILRTQTLLCDMLLRDAPLGIVTQKPNI

SEQ ID NO: 8491 - protein, 310 aa, Zea mays
MARHFVLNTGAKIPSVGLGTWQSDPGVVGNAVYAAVKAGYRHIDCARVYGNEKEIGLALKKLFEEGVVKREDLFITSKLWNDHHAPEDVPEALNDSLNDLQLEYLDLYLIHWPFRVKKGTNTSPENFVTPDFPATWGAMEKLYDAGKARAIGVSNFSSKKLGDLLAVARVPPAVDQVECHPGWQQTKLHSFCQSTGVHLTAYSPLGSPGTTWMNGNVLKEPIIISIAEKLGKTSAQVALRWNIQMGHSVLPKSTNEERIKQNLDVYDWSIPDDLLAKFSEIKQARLLRGNFIVNPESVYKTHEELWDGEL

SEQ ID NO: 8492 - protein, 235 aa, Leersia virginica
LENKISRQVTFAKRRNGLLKKAYELSLLCDAEVALIIFSGRSRLFEFSSSSCMYKTLERYRSCNYNSQDAAAPENEINYQEYLKLKTRVEFLQTTQRNILGEDLGPLSMKELEQLENQIEVSLKQIRTRKSQALLDQLFDLKSKEQQLQDLNKDLRKKLQETSAENVLYMSWQDGGGHSGSATVLAADQPHHHQGLLHPHPEGDHSLQIGYHHTHHHHQAYMDHLNNEADMVAHH

SEQ ID NO: 8493 - protein, 192 aa, Ginkgo biloba
DDHGEVVAEIRRSDLEPYLGLHYPATDIPQASRFLFMKNRVRMISDCLAPPVKVIQDKGLPRDLSLCGSTLRASHGCHAQYMSNMGSIASLVLAVIINEKEDEEGDSEGPQQQKGRKLWGLVVCHHTSPRFVPFPLRYACEFLMQVFGIQLNKEVELAAQLREKHVLRTQTLLCDMLLRDAPMGIVTQIPNI

SEQ ID NO: 8494 - protein, 225 aa, Lithachne humilis
IENKISRQVTFAKRRNGLLKKAYELSLLCDAEVALVIFSGRGRLFEFSSSSCVHKTLERYRSCNYNTQEANAPVENEINYHEYLKLKTRVDFLQTNQRNILGEDLGPLSMKELEQLDNQIETSLKQIRSRKNQVLLDQLFDLKSKEQELQDINKDLRKKLQETNGDQKVVHINSWQDGGQGSSSGHAIEPYQGLIQHPENDPSMQIAYHQVYMDQLNHEDMAAQH

SEQ ID NO: 8495 - protein, 406 aa, Oryza sativa
PQQPPTPLNFLIRRRRQDVRRRRRRREEAAGLRGAEREREEGAVRGAGGAVPARLRAPELIYLTDGASKGVMQMLNTIIRNERDGILVPVPQYPLYSAAISLFGGSLVPYYLEEEANWGLDFVNLRQTVASARSKGITVRAMVIINPGNPTGQCLSEGNIKELLKFCFHENLVLLADEVYQQNIYQDERPFISARKVLFDMGPPMSREVQLVSFHTVSKGYWGECGQRGGYFEMTNLPPKTVDEIYKVASIALSPNVPGQIFMGLMVNPPKPGDISYLKFSAESKSILESLRRRARLMTDGFNSCRNVVCNFTEGAMYSFPQIRLPPKAIDAAKRAGKAADVFYCLKLLEATGISTVPGSGFGQKEGVFHLRTTILPAEEDMPAIMTSFKKFNDTFMDQYDGYSRM

SEQ ID NO: 8496 - protein, 222 aa, Panicum miliaceum
IENKISRQGTFAKRRNGLLKKAYELSLLCDAEVALIIFSGRGRLFEFSSSSCMYKTLERYRSSNYSSQEVKTPLDGEINYQDYLKLKTRVEFLQTTQRNILGEDLGPLSMKELEQLENQVEISLKHIRTRKNQMLLDHLFDLKSKEQELQDLNKDLRKKLQETNAENVLHVSWEEGGHSGASGNAIEPYQGFLQHPENDPSLQIGYHQQAYMDQLNNEDMAD

SEQ ID NO: 8497 - protein, 187 aa, Ginkgo biloba
DDHGEVVAEIRRSDLEPYLGLHYPATDIPQASRFLFMKNRVRMICDCCAPPVKVIQDKKLPQPLSLFGSTLRAPHGCHIQYMANMGSIASLVMSVTINENDDDNGQQQKGRKLWGLVVCHHTSPRFVPFPLRYACEFLMQVLGIQLYKEVELAAQLREKHILRTQTVLCDMLLRDAPVGIVAQTPNI

SEQ ID NO: 8498 - protein, 135 aa, Zea mays
GRGKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 8499 - protein, 222 aa, Pennisetum glaucum
IENKISRQVTFAKRRNGLLKKAYELSLLCDAEVALIIFSGRGRLFEFSSSSCMYKTLERYRSSNYGSQEVKTPSDGEINYQDYLELKTRVEFLQTTQRNILGEDLGPLSMKELEQVENQIEISLKHIKDKKNQMLLNQLFDLKSKEQELQDLNKDLRKKLQETNAESVLHLSWEEGGHSGTGGNAIEPYQGFLQHPENDPSLQIGYHQQAYIDQLNNEDMAD

SEQ ID NO: 8500 - protein, 222 aa, Setaria italica
IENKISRQVTFAERRNGLLKKAYELSLLCDAEVALIIFSGRGRLFEFSSSSCMYKTLERYRSSNYGSQEIKTPLDGEINYQDYLKLKTRVEFLQTTQRNILGEDLGPLSMKELEQLENQIEIFLKHIRTRKNQMLLDQLFDLKSKEQELQDLNKDLRKKLQETNAESVLHVSWEEGGHSGTSGNAIEPYQGFLQHPDNDPSLQIGYHQQAYMDQLNNEDMGD

SEQ ID NO: 8501 - protein, 317 aa, Glycine max
  misc_feature (96)..(96): Xaa can be any naturally occurring amino acid
  misc_feature (112)..(112): Xaa can be any naturally occurring amino acid
MVNVMEWQKQRWQPNGNAEMMYVKVMTDEQLETLRKQIAVYATICEQLIEMHKNISSHQDLAGIRLGNMYCDPLLGSGGHKIASRQRGTPFAMQLXILERIFDQGNWNPARXKIEEITNELHQFGQISETNVYKGVQNRRARSKRKQQNVAPSANVESEVETEVDSKDKKTKPDEFQAPPSVSAGPADNLGFQNHDSSQYLNPESNKPDSVFPSDGTRHFHHVPAFDGLLSNSRNICHTSDSKGFTDQACYTAPPIVGLSAPVRGPPPDGIKLRPPPPPQFSNFFFTYIQSTNDSSSIFISVVFFPQLSHDFGKAFN

SEQ ID NO: 8502 - protein, 90 aa, Kluyveromyces lactis
PAFVNKLWSMVNDKSNEKFIHWSTSGESIVVPNRERFVQEVLKKYFKHSNFASFVRQLNMYGWHKVQDVKSGSMLSNNDSRWEFENERHA

SEQ ID NO: 8503 - protein, 124 aa, Glycine max
MAAISLRKGNTRLPPEVNRVLYVRNLPFNITSEEMYDIFGKYGAIRQIRIGTNKDTRGTAFVVYEDIYDAKTAVDHLSGFNVANRYLIVLYYQQAKMSKKFDQKKKEDEIARMQEKYGVSTKDK

SEQ ID NO: 8504 - protein, 483 aa, Arabidopsis thaliana
MADLLRKVKSIKKKQDQSNHQALILGKYEMGRLLGHGTFAKVYLARNAQSGESVAIKVIDKEKVLKSGLIAHIKREISILRRVRHPNIVQLFEVMATKSKIYFVMEYVKGGELFNKVAKGRLKEEMARKYFQQLISAVSFCHFRGVYHRDLKPENLLLDENGNLKVSDFGLSAVSDQIRQDGLFHTFCGTPAYVAPEVLARKGYDGAKVDIWSCGVILFVLMAGFLPFHDRNVMAMYKKIYRGDFRCPRWFPVEINRLLIRMLETKPERRFTMPDIMETSWFKKGFKHIKFYVEDDHQLCNVADDDEIESIESVSGRSSTVSEPEDFESFDGRRRGGSMPRPASLNAFDLISFSPGFDLSGLFEDDGEGSRFVSGAPVGQIISKLEEIARIVSFTVRKKDCKVSLEGSREGSMKGPLSIAAEIFELTPALVVVEVKKKGGDKMEYDEFCNKELKPKLQNLSSENGQRVSGSRSLPSFLLSDTD

SEQ ID NO: 8505 - protein, 90 aa, Kluyveromyces lactis
PAFVNKLWSMVNDKSNEKFIHWSTSGESIVVPNRERFVQEVLAKYFKHSNFASFVRQLNMYGWHKVQDVKSGSMLSNNDSRWEFENERHA

SEQ ID NO: 8506 - protein, 377 aa, Unknown
  Frankia sp. CcI3
MVCLRGGRGGGGTLSCRRATVADGAPAQWASRDGWNEAMTATDTVTPSDNRAPRDNREPTTGPVPRRADPANSRGNATRPRSMAKAHAEQIVMVVTIVVPLVALAVAIPAMWGQWISWRDVVLAVVFYGITGHGVTIGFHRYFTHRGFRTSRPVRIALAVAGNMAIEGPVIRWVADHRRHHAFSDTEGDPHSPWRYGPGTWSLIKGLWHAHVGWLFDVEQTDQRRFAPDLLDDPDIMKVSRSFALCAFASLALPAVIGGLWGGSFAAALEAFFWAGLVRIALLHHVTWSVNSICHVLGSRPYRSRDRSTNVWPLALLSMGESWHNLHHAEPTSARHGVRPWQIDTSFYLIKMMETVHLVWDVRWPDPARLAAKRATA

SEQ ID NO: 8507 - protein, 503 aa, Micrococcus luteus
MEHQKTTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARI

SEQ ID NO: 8508 - protein, 446 aa, Arabidopsis thaliana
MSKAWKLKLLLLLQLLLLSQHDVDSASVISYLPGFEGLLPFHLETGYIGVGEGEKVQLFYYFIKSENNPEEDPLIIWLTGGPACTALSALAFEIGPLTFKTEGYNGGLPSLVSTSYSWTKVASIIFLDQPVGTGYSYSTTPLSYKPSDTGEAKQTYEFLQKWLVENPQFVSNPIYVGGDSYAGIVVPAIVQQISIGNEHGYKPQINLKGYILGNPSTDLDSDHNSKIPYAHRMGLISDELYESLKRTCQGNYVKVDPTNTKCLKLMEDYGKCVSRINEGLILIALCDLASPNPYSGEHGGRSYLQTLVQSDLSLPTPDCYMYRYLLASHWANDEDVRRELHVVKGSIGKWMRCNWDLPYEKDIKSSVPYHRNNSIIGDYRSLVYSSDHDMMVPYIGTEAWIKSLNYSITDDWRPWFVNNQGGGHTAEYKPEESFMMFQRWISGRPL

SEQ ID NO: 8509 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 8510 - protein, 492 aa, Hevea brasiliensis
MDPYKNLPSNAYNCSFWTTNSGAPVWNNNSSLTVGARGPILLEDYHLLEKLANFDRERIPERVVHARGASAKGFFEVTHNVSQLTCADFLRAPGVQTPVIVRFSTVIHERGSPETIRDPRGFAVKFYTREGNFDLVGNNFPVFFIRDGMKFPDVVHAFKPNPKSHIQESWRIFDFLSHVPESLHMLTFLFDDLGIPQDYRHMEGSGVNTYTLINNAGKVHCVKFHWKPTCGVKCLLEEEAIKVGGSNHSHATQDLYDSIAAGNYPEWKLYIQTMDPDHEDKFDFDPLDVTKTWPEDILPLQPVGRLVLNKNIDNFFAENEQLAFCPGIVVPGISYSEDKLLQTRIFSYSDTQRHRLGSNYLQLPVNAPKCAHHNNHHDGFMNFMHRDEEVNYFPSRCDPVRHSERFPIPSTICSGRRDKCVIEKENNFEQPGERYRSWAPDRQERFLNRMVGCLSDPRITHELRSIWISYWTQCDRSLGQKLAFRLNVRPSI

SEQ ID NO: 8511 - protein, 160 aa, Hordeum vulgare
MTGRRAVAHVFKADLPGVKKEEVKVEVEDGNVLVVSGERTKEKEDKNDKWHRVERSSGKFVRPFRLPEDAKVEEVKAGLENGVLTVTVPKTEVKKPEVKAIEISGCVFESEPFWLMCVRVLQPKYSCDLFLSSLVEASLYRVSFLGRLCTCVIAMNKCST

SEQ ID NO: 8512 - protein, 138 aa, Zea mays
ILFFFPEIEIGLGLTGFGIFFSFLGIIFFFDKGLIAMGNILFLSGLGLTIGLKSTMQFFTKPKNYKGTISFGAGFFLVLIGWPFLGMLLEAYGFVVLFSGFWPTLAVFLQRIPIIGWIFQQPFVTSFLDRYRGKRVPV

SEQ ID NO: 8513 - protein, 162 aa, Daucus carota
MDLRFMGIDHPLFDTLYHILDDDEHDTTDTGNTKRNKSRHERRYVRDAKAMATTAADVKEYPNAYLFVVDMPGLKSGDIKVQVEDGNVLVVNGERKREEEEGVKYLSMGRKVGRFLKKFVVPENANLENIKAVCQDGVLSVTVEKLPPPEPKKPKTIEVQIA

SEQ ID NO: 8514 - protein, 182 aa, Cichorium intybus
  misc_feature (169)..(169): Xaa can be any naturally occurring amino acid
MDPYKQRPSSAYNSPFWTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEXWRILDFLSHHPES

SEQ ID NO: 8515 - protein, 161 aa, Zea mays
MDGRMFGLETPLMVALQHLLDVPDGDAGAGGDKAGGGGPTRTYVADARAMAVTPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 8516 - protein, 272 aa, Lactococcus lactis
MKLNNQIEIPELGLGVFQIPNEETAEVVKNGIINGYRLIDTAKIYENEEGTGQGIKEGLASTGLTREDLFVTSKLWGDNHSYKETIQSFEESLKKLDLDYLDLYLIHWPGTNYAYKEAWKAMEDLYKAGKVKAIGVSNFQKHHLEELLSYAEINPVLNQIELHPKLSQKELREFLKLHDIKVQAWSPLMQGQLLDNEMLKKIADKHGKSVAQIILRWDIQQEILVNVKSIKSERMIANRQIFDFALDQEDMEALNSLNEALRVGPNPDTFNF

SEQ ID NO: 8517 - protein, 774 aa, Streptomyces coelicolor
MTPRPSSSGPDPRKTTGKKPAGKTPTGKKPAKAAKKKAPRRTTASANASATTSVSGAEVAVSPAPDAADRERLLAGTHHDPHAVLGAHRVPGGVAFRVFRPYALAVTVLSGELRVGLHDDGDGFFSGLVPLKDVPAHRLLVAYEGTEQEVEDPYRFLPTLGELDLHLLGEGRHEQLWRALGAHPTTHEGVAGTRFAVWAPNARGVRVAGGFNFWDGTGHPMRSLGSTGVWELFLPGVGAGELYKFEITRPDGSRTFRADPLARRTEVPPATSSVVHASDYTWGDEEWLAHRADAPAHEAPMSVYEVHLPSWRPGLTYRQLAEQLPAYVADLGFTHVELMPVAEHPFGGSWGYQVTGFYAPTARLGDPDDFKYLVDRLHRAGIGVLMDWVPAHFPRDDWALAEFDGRPLYEHSDPLRAAHPDWGTLEFDFGRREVRNFLVANAVYWCEEFHIDGLRVDAVASMLYLDYSREPGEWEPNEHGGRENLDAVAFLQEMNATLYRRVPGVVTVAEESTAWDGVTRATHHEGPSGFGGLGFGLKWNMGWMHDSLDYMSHEPVHRKHHHGEMTFSMVYAYSENYVLPISHDEVVHGKRSLVSKMPGDWWQQRANERAYLGFMWAHPGKQLLFMGQEFAQGAEWSEAHGPDWWLLDPEYGASADHRGVRDLVRDLNTVYRATPALWRRDTHPSGFSWVVGDAAEDNVLAFLRLDADGTPLLAVSNFAPVVRSGYRLGVPDEVPAWHEVLNTDAARYGGGDVVNPDPVKPEPQGGTAARRASG

SEQ ID NO: 8518 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 8519 - protein, 554 aa, Salmonella enterica
MCSIFGVFDIKTDAAELRKKALELSRLMRHRGPDWSGIYACDNAILAHERLSIVDVNAGAQPLYNAKKTHVLAVNGEIYNHQTLRAEYGDRYAFQTGSDCEVILALYQEKGPDFLDDLQGMFAFALYDSEKDAYLIGRDHIGIIPLYMGYDEFGNFYVASEMKALTPVCRTIKEFPAGSYLWSKDGEIRQYYQRDWFDYDAVKDNVTDKNALRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMYDCTRANKAMSAWGVEARVPFLDKKFLDVAMRINPQDKMCGNGKMEKHVLRECFESYLPASVAWRQKEQFSDGVGYSWIDTLKEVAAKQISDQQLETARFRFPYNTPSSKEAYLYREIFEELFPVPSAAECVPGGPSVACSSAKAIEWDEAFKTMDDPSGRAVGVHQSAYQ

SEQ ID NO: 8520 - protein, 142 aa, Zea mays
KEQFSDGVGYSWIDGLKDHASQHVSDSMMMNAGFVYPENTPTTKEGYYYRMIFEKFFPKPAARSTVPGGPSVACSTAKAVEWDASWSKNLDPSGRAALGVRDAAYEDTAGETPASADPVSDKGLRPAIGESLGTPVASATAV

SEQ ID NO: 8521 - protein, 268 aa, Brassica napus
  misc_feature (124)..(124): Xaa can be any naturally occurring amino acid
MALEAMNSPTTMSSFTVRKDRIGATDDLMNDAVFLEPWLKRKRSKRQRSPSPSSSPPRSHAKSQSQDPSEEEYLALCLLMLAKDQPRTRFQPSLPPPPQARTKLSYNCSVCGKAFLSYQALGVXEASHRIKPPTAGDSTAPSIAGEKHPTSTTIAPSGKIHECSICHKVFPTGQALGGPKPCHYEGNLGGGGGGSKSVSPSGSVSSTVSEGRNTRVIIDLNLPALPELSLHPDSVVDEKILSPLTGKKPLLLAGPAQVIKKKDLSLRI

SEQ ID NO: 8522 - protein, 206 aa, Pyrococcus horikoshii [sequence omitted]

SEQ ID NO: 8523 - protein, 1081 aa, Candida albicans
  misc_feature (736)..(767): Xaa can be any naturally occurring amino acid
MNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYXXXXXXXXXXXXXXXXXXXXXXXXXXXXXXXXGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGTVEGGGTSSRPVQRRSATEGSITTISEQIDR

SEQ ID NO: 8524 - protein, 345 aa, Bacillus thuringiensis
MNSELFSPYTIKDVTLKNRIVMSPMCMYSSENEDGQVTNFHLIHYGTRAAGQVGLVMIEATAVLPEGRISNKDLGIWDDSLIEGLHKTTTFIHDNGAKAAIQLAHAGRKAELETDALAPSAIPFNETMKIPVEMSIQQIKNTILAFQQAAVRSKQAGFDVIEIHGAHGYLINEFLSPLSNKRTDEYGGSPEKRYRFLREIIDSINEVWNGPLFVRISANDYHPDGLTVQDYIQYTKWMKEQGVDLIDCSSGAVVPARIDVYPGYQVQYAKHIKEHANIATGAVGLITTGAQAEQILTNNEADLIFIGRELLRNPYFPRIAANELGFELEEPYQYERAPGKISTNK

SEQ ID NO: 8525 - protein, 1168 aa, Neurospora crassa
MSTAFQTTPNQSISVSATTSPSNRQYSSFHPGPTTREGPGSGYYANQHNAGQSSPHTSSQPHSRRPSAYDQPTGLEPHMSARTAFAQSIPAPVTSIASDQPPSSSDRRRNNMPTAVPPRTSSRHDPNTSSRRAQQAADRAAASRQSNTNGTMDPAVVDEAAARSRRQHQMTQDAHQRTTSSRGNPTPTSLPVRSQPNATSSRQQSSREASEILNNILIQQPEIDIERERERLAQAQAQAHAQAQAQAQAQAQAQAQQASNYNHHHRQETASQAMAAPGGDHGEESRRGHRSRHDHSKREKHTKFGEYILGNTIGEGEFGKVKLGWKQEGGVQVAIKLIKKDTVGNNPSRMAKIMREVAILKQLTHPNIVRLHKMEESDRHYGIVLEYASGGELFDYILNHRYLKDNAARRLFAQLVSGVGYLHKKGIVHRDLKLENLLLDRNRNIIITDFGFANTFDPNQELSEEEELNLSDREFVKRMGLDKVNDAGWRKGDLMQTSCGSPCYAAPELVVSDSLYTGRKVDVWSCGVILYAMLAGYLPFDDDPANPEGDNINLLYKYIVNTPLTFPEYVTPHARDLLRRILVPNPRKRADLFEVARHSWLSEYSHVVEFITSSTTTPSEIQNTTVPAEDEGESPHLARSASVREAPKKSTASPAIGGLVSKQGTVDPEAEAAYAKQQRDNKRRTVQVEYVAPNTTTQRGDIAGQQQPSSNANRNRNESQAPVESSDSRPTTSAKDKQLSQGPSAPKDAYNNKPPVSSRRPPSSQRNGGNAPTTGNAVAPPRPSRDGRPTADNQYLSGAAGAPTQRPTTGGSMQSGRPSYAQPAPPEVADANVHGRIQQPSKGSGSSHFGVPTTTPAEQQPSESADYGRPSISTGSRFDKVREDGVVKGHKRSSTMGEIGGKLFGRSGSLFGGRKSKRQQELQQAGEKTKRYPPVSMNNSMPGGENGSRPSLDSKRSRRSFSMGMGKKSSGGSITGSNGSQEKSNKRFSFIPPSLSRAFGYNKEDEPPALDSQQDLPIQEPSSVDQFLGREQNVSATTVDGMYTQLQDSQQGSPAVNTQYQYGRPSASQGFMPGTMPNAGSDPSVNSMPQAPGSTPQLQTMTQQDGLYDARKGNSRANRGVLQKNKRFVDYEGDGFARPHDHSGSSGPARKVMDFFRRRGKARGGENN

SEQ ID NO: 8526 - protein, 106 aa, Glycine max
MASIIVIALFAQFYKKKFPENRDFLIACIALYVIFNGLLQLIIYTKEKNAILFTYPPVGSFTSTGLVVSSKLPRFSDMYTLTIASADPKSISANDQVHFTKSVTQW

SEQ ID NO: 8527 - protein, 509 aa, Xanthomonas campestris
MRVAVLSVALSLALFASPGWAQKAGPAAAQASADDPEANEAAVSKVPLDEIRRFVAVYNAVKQAYVDPVEDKKLMHSAVRGLLSDLDPHSTYFDKEDAEAFDEQATGAYDGIGVELLQQQDNTLKVIAPIDDTPAARAGIRAGDVIVAIDGKPIDASKAMEPLRGESGSKVVLTIMRDKTPKPFDVTLQRETIRVASVRSKLLEPGYGYIRISTFQADTGADFQKNLKQLQAGGKLRGLVLDLRSNPGGLLTSAVQVADDLLDKGNIVSTRGRISISDAKFDATPGDLLSGAPVVVLVDAGSASASEVLAGALRDNKRARIIGSRTFGKGSVQTVLPLDNGDSVKLTTARYYTPSGKSIQASGIMPDVLLTPEPQPGDADVPASLTDYSEATLPGHLRGDDEGEEGYSAGDVLPGDGPIAEALAELKQPGSVAKAQAARKAKAQAAQKAKPAKTGADPKPAAARPATTDKPTSAEPAGKAKPATAPAAPAEPVQPAPPKDTPASTEPAN

SEQ ID NO: 8528 - protein, 261 aa, Physcomitrella patens
MVEKVVVSSLRVKRGGNLLAPLKRNVSSIAKKSSTPKSGKPVGSPKVYKGVRMRTWGKWVSEIREPNKRSRIWLGSFPTAEMAAKAYDAAAVCLRGRSVKLNFPDSPPRCAARCNSPREVQAAATAAAVACIPSATALTVANFQSPAQTLESSPLHSSPSSSDMSSGDEDSGEDSVQSFVAEGSQISPSEVVPVLEWVKVEFGDKETVAAGDVDFDCDYSFISEFAADSLLACSYNSKGRTEYLPIETHDAALYDSTLWFF

SEQ ID NO: 8529 - protein, 184 aa, Oryza sativa
MLRRRGFCCCSGAPTAAAAALLLLAVAAAAPRAAGFHLGGDESVLVRGMLAAIRREQAEAEDAARFAVAEYNKNQGAELEFARIVKAKRQVVTGTLHDLMLEVVDSGKKSLYSAKVWVKPWLDFKAVVEFRHVGDSQSQSATAADDNAGQDTADPTVASRNDLHNTENNKVSVVLSTFSQTYSV

SEQ ID NO: 8530 - protein, 347 aa, Unknown
  Synechocystis sp. PCC 6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 8531 - protein, 480 aa, Listeria monocytogenes
MKELLTFPKDFWWGSAWSAEQAEGRGDTGKAKTVWEHWFETEPNRFYEGVGSEITTDHFNRYKEDVQWMKKTGQNSFRISISWARMFPDDGVGEVNQKAIAFYRDLLTEMNENGVKPFANLYHFDMPVALQDAGGWESREVVDAYVHFADTCFKEFGDLVYHWFTFNEPLGPILGGYLEGFHYPNQIDFKRGTQAGFNTILAHTLAIKAFKKINLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYETSKLVGTKREETTNG

SEQ ID NO: 8532 - protein, 206 aa, Clostridium perfringens
MLIKTIPVGMYQANCYVVIDEETKDCIMVDPGEEASRIENVIESLDAKPKMILLTHGHFDHVGAVQKLAEKYKIPFYIDKKDEDMIERNVDVFGKLPKADGYLKDGDTLKFSDNYEIKCLETPGHTPGGLCFLIDNCLFTGDTLFRESIGRSDFEGGNHATLLKSINDKLVPLGDDIVVYPGHGPSSTIKHERQRNPFLAGDFYVY

SEQ ID NO: 8533 - protein, 488 aa, Carica papaya
MGFGTNQSLLSKIATNDRHGEDSPYFDGWKAYDRNPFHPTRNPDGVIQMGLSENQLCFDLIEKWVKKNPNASICTAEGVENFKHIANFQDYHGLKEFRQEVAKLMGKARGGRVTFDPERIVMSGGATGASETIMFCLADPGDASLVPTPYYPAFNRDLRWRTGVQIIPVQCSSSNNFTVTREAVEAAYQKAQEANINVKGLIITNPSNPLGTTLDSQTLQSLVNFVNDKTIHLVCDEIYAATVFSSPEFVSIAEIIQEMDVNRDLIHIIYSLSKDMGLPGFRVGIVYSYNDGVLSCGRRMSSFGLVSSQTQYFLATLLSDDEFVDYFLRESSKRLARRHHKLTRGLEQVGIKCLKSNAGLFVWMDLRRLLEGPTSFDAEMKLWRTIVNDVKLNVSPGSSFHVAEPGWFRVCFANMEEETMDVALQRIQAFVCRAKEREAAAAATTNKKRGTMNLRLSFSSRNQVYEEQYYAMSPHMMSPRSPLVEART

SEQ ID NO: 8534 - protein, 494 aa, Zea mays
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 8535 - protein, 648 aa, Pseudomonas aeruginosa
MNFPHLFSPLEIRGKRLKNRIMSSGHDTSMPTDNLVNEPLVAYHRARARGGAGLIVMQVAGVHDSARYTSHVLMATDDACIPGYRRVAEACHAEGCVVLSQIFHPGREIMESADGLLAVAYSASASPNERFRVMPRELDQPLIDEIVAGYAAAARRLHQAGLDGVEVVASHGYLPAQFLNPRVNRRTDGYNGDLDARLRFLREVLAAVRAATSEDFIVGLRLSADERDPEGLSESESLQAAEAVQGELDYLHIVAGTSASLGGAIHIVPPMAIEPAYLAREAGTFKARLAIPLFVTGRINQPQEAEAILARGQADVCGMTRALICDPQMPNKAEAGRSDDVRACIACNQACIGHFHRGYPISCIQHPETGRELTYATPNPASRRKRVLVAGGGPAGMKAAAVAAQRGHEVVLCEAGAQLGGQVNLAQLLPRRAEFGGASTNLQREMQLAGVEVRRNTPVDRALVERERPDLVIVATGAEPYWPPFERGGELQVVDAWQVLRGEVRVGRSVLVTDWRGDWIGPGIAEKLVREGHQVRLAVNGTHCGESLPLYVRDQLAGELHRLGIPVTPYARLYGCDDTTVYMQHSASGEAMLFEEVDTLVLCQGHQPVDRLADSLHGLAEVLRIGDCLAPRTAEEAIYEGLKAAWSI

SEQ ID NO: 8536 - protein, 367 aa, Glycine max
  misc_feature (261)..(261): Xaa can be any naturally occurring amino acid
MRRWLCCTCQVEESYPSNENEHLKSPRNYGDGNQKGSKVSAPVKPETQKAPPPIEAPALSLDELKEKTDNFGSKALIGEGSYGRVYYATLNNGKAVAVKKLDVSSEPESNNEFLTQVSMVSRLKDDNFVEMHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKXSDVYSFGVVLLELLTGRKPVDHTMPRGQQSLVTWATPRLSEDKVKQCVDPKLKGEYPPKGVAKLGAVAALCVQYEAEFRPNMSIVVKALQPLLKSPAPAPAPVPES

SEQ ID NO: 8537 - protein, 185 aa, Glycine max
MVQTKKFRGVRQRQWGSWVSEIRHPLLKRRVWLGTFETAEAAARAYDQAAILMNGQNAKTNFPTSKNQAEADDNNNTDTFLSPKALSELLSTKLRKYCKDPAPSLTCLRLDADNSHIGVWQKGAGPHSGSNWVMRLELGKKQITEEGSESTESPQSSTNGATENNEVEEEDRVALQMIEELLNWN

SEQ ID NO: 8538 - protein, 175 aa, Xylella fastidiosa
MHPQNFQHQLKTMPQPPDETRDFVFNHTMLRVKDINASLDFYARILGFRLIDQRDFPEAQFSLYFLALLPQTVHISDNDAERRLWMSGIPGVLELTHNYGTETQEGQIYHDGNNEPRGFGHICISVPDLYSACARFDTLQVPYQKRLTDGRMKNIAFIKDPDGYWVEIISNTPLP

SEQ ID NO: 8539 - protein, 482 aa, Lactobacillus johnsonii
MTGYTMPKGFLWGGAVAAHQLEGAWDEDGKGMSVADVMTVGSATKPREITDGVIPGKNYPNHEAIDFYHHYKGDIKLMAEMGFKAFRTSIAWTRIFPKGDEEEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYELVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLERSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGDGTLERSKKDSFNWYKKVIESNGKDLD

SEQ ID NO: 8540 - protein, 539 aa, Moorella thermoacetica
MAAKQLAFDVEARRALEKGVSTVAQAVKVTLGPKGRNVVLERKFGSPVITKDGVTVAKEIELKDPYENMGAQLCREVASKTNDVAGDGTTTATVLAQAIMLEGLKNVAAGANPIFVKKGIDRAVETVVDEIKKISIPVESKESIAHVASIAANEREIGELIADAMEKVGKDGVITVEESKGTATTVEVVEGMEFDRGYVSPYFVTNTEAMEAEFEEPYILIHEKKISAINDLLPLLEKVVRTGKPLVIIAEDIEGEALATLVVNKLRGTLNCAAVKAPGFGDRRKAMMEDIAILTGGTFLSEDLGVKLENVDLNMLGRAKKVKIAKEKTTIVEGYGKKEAVDGRIAQIKKQIEETDSDYDREKLQERLAKLAGGVAVIRVGAATETELKEKKHRVEDALAATRAAVEEGIVPGGGATLVHAIPAVEKIQAEGDEAVGVRIVRRALEEPLRQIAANAGLEGSVIVERVRSEQPGIGFDAVKEEYVDMIKAGIVDPAKVTRSALQNAASIASMLLTTEAIIAEIPKEEKAPAMPPGGGMDY

SEQ ID NO: 8541 - protein, 257 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSHYNHNPANATNSATTSQNVNGFFPGWMV

SEQ ID NO: 8542 - protein, 337 aa, Ashbya gossypii
MQGSVRAIRSLARQFRTMSVEKIYYPRKVQTAASDASLTLNHTSFRIKDPKVSVPFYEKHFGMQLLQKLEFPEQQRDVYVMSFPKQVNKLENGAPGIFHLSGTLHLAHSHGTENDAGYRPNNGNEEPHRGFGHICFSVADLPKECERLEAEGVAFKKRMSDGRQKNIAFALDPDGYWIELIQYNLSDAEPVDLGPKFNHTMLRVKDATKSLEFYQNVLGMSLLEVSEHANAKFTLYFLGYPAADERLKRESILELTHNWGTEDDADFSYHNGNAEPTGYSHMGVSLSDPAPLCADIEETYPDLEWELRYNKGSIKNLAVLRDPDGYHIQVLPRTWSL

SEQ ID NO: 8543 - protein, 523 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKNLSVPCSDSKAITQVGTISANADEKVGALIAEAMEKVGNDGVITVEEGTGLQNELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGIGEKHTIQSRISQIRQEIQEATSDYDKEKLNERLAKLSGGVAVLKVGAATEVEMKEKKARVEDALHATRAAVEEGVVAGGGVALVRVAGKISHLRGQNEDQNVGIRVALRAMEAPLRQIVSNSGEEPSVVTNNVKDGKGNYGYNAASDQYGDMIDFGILDPTKVTRSALQYAASVAGLMITTECMVTD

SEQ ID NO: 8544 - protein, 115 aa, Zea mays
HASSNTLDGLNGFDGTDTHYFHSGPRGHHWMWDSRLFNYGNWEVLRFLLSNARWWLEEYKFDGFRFDGGTSMMYTHHGLQVTFTGNFNEYFGFATDVDAVVYLMLVNDLIHGLYP

SEQ ID NO: 8545 - protein, 481 aa, Populus euphratica
MVFKLNSHLLSRIASSDGHGEDSPYFDGWKAYDSDPHHPTDNPNGVIQMGLAENQLCFDLIQDWLKKNPKASICSPEGLNEFREIAIFQDYHGLPEFRNAVANFMEKVRGNRVTFDPDRIVMSGGATGAHETIAFCLADPGEAFLVPTPYYPGFDRDLRWRTGVKLIPVDSDSSNNFMVTREALENAYEKAQLDNIKVKGLLITNPSNPLGTILDRETLRSIVRFINEKNIHLVCDEIYAATVFSQPDFISVRRILQEDIECNLDLVHIVYSLSKDMGFPGLRVGIIYSYNDAVVSCARKMSSFGLVSTQTQYLIASMLSDNEFVEMFIRESKRRLAARYRVFTRGLDQVGIECLKTSNAGLFLWMDLSRLLKQQTFKAEMELWRVIIHEVKLNVSPGCSFHCLKPGWFRVCFANMDDETMQVALSRIKTFVNKEADTKKSRKNLRWQGSLKLLNSPRIYDDFINSPHSPIPQSPLVRARN

SEQ ID NO: 8546 - protein, 548 aa, Escherichia coli
MAAKDVKFGNDAHVKMLRSVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8547 - protein, 486 aa, Unknown
  Populus x canadensis
MERQHQLLSKIATNDRHGENSPYFDGWKAYDKNPFHPTDNPDGVIQMGLAENQLSADSIIDWIKKHPKASICNPEGVHMFKDIANFQDYHGLPEFRQAIAKFMGRVRGGRVTFDPDRIVMSGGATGANELIMFCLADPGDAFLVPSPYYPAFYRDLGWRTGVQIVPVDCDSSNNFQITKVALEAAYDKAQQDGINVKGLIITNPSNPLGTTLDRETLKCLLSFINEKNIHIVCDEIYAATIFSSQNFVSVSEVIEEVMDCNRDLIHIVYSLSKDMGLPGFRVGIVYSYNDAVVNCGRKMSSFGLVSSQTQYLLASMLSDEEFVEDFLAESSKRLKKRHGIFTKGLEQIGISCLESKAGLFVWMNLRHLLKEQTNDGEMELWRVIVNDVKLNVSPGSSFHCVEPGWFRVCFANMDDETLEVALKRIHAFVGEQKERETLSTKTKDMPSKTKCWKKNLRLSFSSRIFEEGIGSPIAMSPHSPLVRART

SEQ ID NO: 8548 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGRQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGIGGVM

SEQ ID NO: 8549 - protein, 117 aa, Saccharomyces cerevisiae
MSSSTPFDPYALSEHDEERPQNVQSKSRTAELQAEIDDTVGIMRDNINKVAERGERLTSIEDKADNLAVSAQGFKRGANRVRKAMWYKDLKMKMCLALVIIILLVVIIVPIAVHFSR

SEQ ID NO: 8550 - protein, 115 aa, Zea mays
  misc_feature (81)..(81): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQXTFTGNFNEYFGFATDVDAXVYLMLVNDLIHGLYP

SEQ ID NO: 8551 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGTKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8552 - protein, 479 aa, Gibberella zeae
MSSLATKQQSLKIFEKLKTKPANKICFDCGQKNPTWTSVPFGIYLCLDCSSNHRNLGVHISFVRSTNLDQWQWDQLRVMKVGGNESATKFFQQNGGTAALNSKDPKTKYQSNAATKYKDELKRRAARDAQDYPTEVIITDAIDDGSATPAGEPDDDFFSSWDKPAIKRPTPPVSRTGTPPVVGRTPSPFLNSGNGKDIARTASPLSRTSTGENKPASRITTSAALRKTPASTGPRKANVLGAKKTTKLGAKKVTADIIDFDEAERKAKEEADRIAKLGYDPDAEEDPATKNSGSAAAIISPTPVAPSRGSASSHTRQKSDAEVERLGMGMNRLGFGQVGGPKAAASSAPKRNAGGFGSVGPVRAQDVDDSERYAREKFGTQKGISSDEFFGKGAFDPSQQSEAKTRLQGFEGATAISSNAYFGRPEDEPEEEYGDLESAAKDFVRKFGITAGDDLENLTQMAGEVSTRLQGAIRSYLGN

SEQ ID NO: 8553 - protein, 424 aa, Brassica oleracea
MATTPMCTEWQFSGNEAAKEAAAAALGAYTSKLMALCDPNGKPILPPSNKAVETSNSAEKAVVKFILSGTGNAYAPSIGLPLAKSAVAEYLNRDLPKKLTAADVFMTVGCKRAIDLAVDILAKPKANVLLPRPGFPWDVVRCIYKKLEVRYYDFIPEQNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKILQAANEFLQINAKPPTVIQAAMPDILERTPKHFFHERGSFLKHKVDIGYSKVKHIPGLTCYMKPEACTFLWTKLDISCFADIEDDQDFCRKLAMEENLVVLPGIAFRQKNWLRHSIDMETQTVEDAFERLKSFCERHSAERGASLKNVNGVN

SEQ ID NO: 8554 - protein, 484 aa, Thermobifida fusca
MTSQSTTPLGNLEETPKPDIRFPSDFVWGVATASFQIEGSTTADGRGPSIWDTFCATPGKVENGDTGDPACDHYNRYRDDVALMRELGVGAYRFSIAWPRIQPEGKGTPVEAGLDFYDRLVDCLLEAGIEPWPTLYHWDLPQALEDAGGWPNRDTAKRFADYAEIVYRRLGDRITNWNTLNEPWCSAFLGYASGVHAPGRQEPAAALAAAHHLMLGHGLAAAVMRDLAGQAGRSVRIGVAHNQTTVRPYTDSEADRDAARRIDALRNRIFTEPLVKGRYPEDLIEDVAAVTDYSFVQDGDLKTISANLDMMGVNFYNPSWVSGNRENGGSDRLPDEGYSPSVGSEHVVEVDPGLPVTAMGWPIDPTGLYDTLTRLANDYPGLPLYITENGAAFEDKVVDGAVHDTERIAYLDSHLRAAHAAIEAGVPLKGYFAWSFMDNFEWALGYGKRFGIVHVDYESQTRTVKDSGWWYSRVMRNGGIFGQE

SEQ ID NO: 8555 - protein, 239 aa, Eriobotrya japonica
MGGGRVQLKRIENKINRQVTFSKRRTGLLKKAHEISVLCDAQVAVVVFSNKGKLFEYATDSCMEQILERYERYSYAERQLVEPEFESQGNWTFEYCRLKAKVEVLQRNHRHYLGEDLDSLTLKEIQNLEQQLDTALKQIRLRKNQLMHESISELQRKRKAIQEENNLLAKKIKEKEKAAAQPQVQDWEQQNIGLDLLPQPLPCLNNGGTQQDEFLQVRRNQLDLTLEPLYSCHLGCFAA

SEQ ID NO: 8556 - protein, 82 aa, Glycine max
CVLKCEYAVRGEVVTLAQNLQKDLQANPGSHPFDEILYCNIGNPQSLGQQPITFFREVLALCDHPAILDKSETQGLFSSVAI

SEQ ID NO: 8557 - protein, 633 aa, Unknown
  Phalaenopsis hybrid cultivar
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEVLGKGCTTIFIVKVGISEDPAHRYQHKLLPPIRAGQSEADAFGSKRTPTDLIPLKNRYQRSL

SEQ ID NO: 8558 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 8559 - protein, 338 aa, Vibrio vulnificus
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 8560 - protein, 492 aa, Gossypium hirsutum
MDPYKHRPSSAFNSPFWTTNSGAPVWNNNSSLTVGPRGQYLLEDYHLVEKLANFDRERIPERVVHARGASAKGFFEVTHDISHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDLGVPQDYRHMEGSGVNTYTLINKAGKAHYVKFHWKPTCGVKCLLEDEAIKVGGANHSHATQDLYDSIAAGNYPEWKLFIQTIDPDHEDKFDFDPLDVTKTWPEDILPLQPVGRLVLNKNIDNFFAENEQLAFCPAIVVPGIYYSDDKLLQTRIFSYSDTQRHRLGPNYLQLPANAPKCAHHNNHHEGFMNFMHRDEEINYFPSRYDPVRHAEMFPIPPAVCTGRREKCIIEKENNFKQPGERYRSWAADRQERFICRWVDALSDPRVTHEIRSIWISYWSQADKSVGQKLASLLNVRPSI

SEQ ID NO: 8561 - protein, 705 aa, Rhodopseudomonas palustris
MAKSAKPTKNRTATIHDQKMSRGEGGELHQTAEDLGTEVMTTAQGGPISDDQNTLKIGPRGPALIEDFHFREKIFHFDHERIPERVVHARGYGAHGFFETTHSLAKFSRADLFQRVGERTPAFVRFSTVAGSKGSVDLARDVRGFAVKIYTKEGNWDLVGNNIPVFFIQDAIKFPDLIHSVKEEPDRAFPQAQSAHDNFWDFISLTPESMHMVMWVMSDRAIPRSFRFMEGFGVHTFRLVNADGESTFVKFHWKPKLGMQSVLWNEAVKINGADPDFHRRDLWTAISTGNFPEWELRVQLFDQEFADKFDFDILDATKIIPEEIIPPVPVGRLVLDRMPDNFFAETEQVAFMTQNVPPGIDFSNDPLLQGRNFSYLDTQLKRLGSPNFAHLPINAPKCPFAHFQQDGHMAMHNPVGRANYQPNSHGLGPRESPQRGFVPFPEAEEGAKAKFRAESFADHYSQARQFYLSQTRTEQHHIVSALTFELSKVEISVIRERVLSHLLLIDETLATNVANRLGIKAMPKPADAAVPTRQDLPPSPALSIIENGPERFGGRKLGILITDGTDAALLKSLQKAVEKAGATFELIAPRVGGVIASDGSEIAAHQMIDGGPSVLYDAVALLPGDDEIDDLLQESTARDFVADAFAHCKFIGYVAAARPLFAKAGIGDDLDEGCIELAARKDAGAFVDQLGKLRVWARESVVKMR

SEQ ID NO: 8562 - protein, 478 aa, Glycine max
MAASVSTVGAVNGAPLSLNSSGAGASVPSSAFFGTSLKKVIASRVPNVKISSGSFKIVAAEKEIDEKQQTDKDRWKGLAYDVSDDQQDITRGKGLVDSLFQAPQDTGTHYAIMSSYEYLSTGLKQYNLDNNMDGFYIAPAFMDKLVVHISKNFMTLPNIKVPLILGIWGGKGQGKSFQCELVFAKMGINPIMMSAGELESGNAGEPAKLIRQRYREAADMIKKGKMCALFINDLDAGAGRLGGTTQYTVNNQMVNATLMNIADNPTNVQLPGMYNKEENPRVPIIVTGNDFSTLYAPLIRDGRMEKFYWAPTRDDRVGVCNGIFRTDNVPKDDIVKLVDTFPGQSIDFFGALRARVYDDEVRKWISVVGVDFIGKKLVNSKEGPPTFDQPKMTLSKLLEYGNMLVQEQENVKRVQLADKYLKEAALGDANQDSINRGTFYGKAAQQVNIPVPEGCTDPNASNFDPTARSDDGTCLYTP

SEQ ID NO: 8563 - protein, 115 aa, Zea mays
HASSNTLDGLNGFDGTHTHYFHSGPRGHHWMWDSRLFNYGNWEGLRFLLSNARWGLEEYKFDGFRFDGGTSMMYTHHGLQVTFTGNFNEYFGFATDVDAVVYLMLVNDLIHGLYP

SEQ ID NO: 8564 - protein, 303 aa, Arabidopsis thaliana
MSISQFPPPASPSPASSSRSLASSSPSPGSFSSSMRLWRPAAQRNLRNQWSNLSNCRQQWIVACSAGRSHATLLVNSYLSQKYMPMMELGVLSDMFDIDKKALKKLFTQQSSYRIKLLSSYKEMVAVVVEMVNASRSLRCYTKLSTGSLIQFSGTKEDSNDAGDCGGIPFGTCHVEMIPEKMAEELVEMFKREVMLKRLLIMELISLSTEVPQPINNSWSDELYHGEFDHLTKCSLYSMEVAKPVLPRVKDYNIGSSSISHTNQPTAEILQIYLTTWLAEVNIDTHRVDEILALVGEEIRVTF

SEQ ID NO: 8565 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINEDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8566 - protein, 115 aa, Zea mays
  misc_feature (45)..(45): Xaa can be any naturally occurring amino acid
  misc_feature (55)..(55): Xaa can be any naturally occurring amino acid
  misc_feature (64)..(64): Xaa can be any naturally occurring amino acid
  misc_feature (74)..(74): Xaa can be any naturally occurring amino acid
  misc_feature (76)..(76): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVXRFLLSNARWXLEEYKFDGXRFDGVTSMMXTXHGLQVTFTGNFNEYFGFATDVDAXVYLMLXNDLIHGLYP

SEQ ID NO: 8567 - protein, 457 aa, Geobacter metallireducens
MVQTRTKITLGLMAVIACLAFGGATLWRLAATAPDREGVASLKLLAEVLRQVEENYVERVDRKKLLEGAVNGMLAALDPHSAYLPPEPFSEMKVEISGSFGGLGIEIALKEGKLTVISPIEDTPAWRAGIKAGDHIWKIDGTPTRDLTIVQAVKKMRGERGTKVTLTILRNGETEPREFPLVRDIIQTKSLKARSLEPGYGYVRISHFQERTGEDFANALRNLRAENGGTLKGLVLDLRNNPGGLLEVAVAVAGRFVGERLDNGLIVYTEGREEFAKRRFSATVGEKEPPYPLVVLINSGSASASEIVAGALQDYGRAVIMGTPSFGKGSVQTVIPMKDGAGLKLTTALYYTPKGRSIQARGIIPDVIVENAELKSVTKDRREDFHEKDLDNHLGGGKDAVPAKGPIEKNEESGKKGQPARHAVGPEDDAKKDFQLARALDLLKSWEVLQKVAGGIK

SEQ ID NO: 8568 - protein, 439 aa, Triticum aestivum
MSTTKVKRRVGKYELGRTIGEGTFAKVRFARNTETGDPVAIKILDKEKLLKHKMVEQIKREIATMKLIKHPNVVRIHEVMGSKTKIYIVLEYVTGGELFDTIVNHGRMREDEARRYFQQLINAVDYCHSRGVYHRDLKPENLLLDSCGNLKVSDFGLSALSQQLKDDGLLHTTCGTPNYVAPEVLEDQGYDGAMADLWSCGVILFVLLAGYLPFEDSNLMALYKKISDAEFTFPPWTSFPAKRLLTRILDPNPMTRITVQEMLEDEWFKKGYKRAEFDEKYDTTLDDVDAVFNDSEEHHVTEKKEEEPVALNAFELISMSAGLNLGNLFDSEQEFKRETRFTSKSSPKEILRKIEEAAKPLGFDIQKKNYKLRLEKVKAGRKGNLNVATEILRVGPSLHMVEVRKAKGDTLEFHKFYKNLSNTLKDVVWKSDDLQIQPS

SEQ ID NO: 8569 - protein, 196 aa, Triticum aestivum
  misc_feature (148)..(148): Xaa can be any naturally occurring amino acid
  misc_feature (182)..(182): Xaa can be any naturally occurring amino acid
  misc_feature (185)..(185): Xaa can be any naturally occurring amino acid
MSVPEAGQSAGRDEQEMDDYEQHQTRVLMALMQGLCAARYRKADNTPCLVDQGLYLGSVGAALNNEALKSLNITHILVVARSLNPAFPAEFTYKKIEVLDSPDTDLGKHFGECFTFIDEGICTGGNVLVHCFAGRSRSVTVVLAYLMXKHQMSLQSAMSLVRSKRPQIAPNAGFISQLVNFXKSXQVEQGQRTLQN

SEQ ID NO: 8570 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDRDKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8571 - protein, 550 aa, Yersinia enterocolitica
MAAKDVKFGNDARIKMLRGVNILADAVKVTLGPKGRNVVLDKSFGSPTITKDGVSVAREIELEDKFENMGAQMVKEVASKANDAAGDGTTTATVLAQSIITEGLKAVAAGMNPMDLKRGIDKAVIAAVEELKKLYVPCSDSKAIAQVGTISANSDSTVGELIAQAMEKVGKEGVITVEEGPGLQDELDVVEGMQFDRGYLSPYFINKPETGSIELESPFILLADKKISNIREMLPVLEAVAKAGKPLLIIAEDVEGEALATLVVNTMRGIVKVAAVKAPGFGDRRKAMLQDIATLTVGTVISEEIGLELEKTTLEDLGQAKRVVINKDTTIIIDGVGDEAAIQGRVTQIRQQIEEATSDYDKEKLQERVAKLAGGVAVIKVGAATEVEMKEKKARVEDALHATRAAVEEGVVAGGGVALIRAASAITAAGLKGDNEDQNVGIKVALRAMESPLRQIVVNAGEEASVIANNVKAGSGSYGYNAYSEEYGDMIAMGILDPTKVTRSALQYAASIAGLMITTECMITDLPRDDKGADMGAGGMGGMGGMGGMM

SEQ ID NO: 8572 - protein, 115 aa, Zea mays
  misc_feature (55)..(55): Xaa can be any naturally occurring amino acid
  misc_feature (64)..(64): Xaa can be any naturally occurring amino acid
  misc_feature (83)..(83): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVLRFLLSNARWXLEEYKFDGXRFDGVTSMMYTHHGLQVTXTGNFNEYFGFATDVDAVVYLMLXNDLIHGLYP

SEQ ID NO: 8573 - protein, 279 aa, Gluconobacter oxydans
MSSQVPSAEAQTVISFHDGHTMPQIGLGVWETPPDETAEVVKEAVKLGYRSVDTARLYKNEEGVGKGLEDHPEIFLTTKLWNDEQGYDSTLRAYEESARLLRRPVLDLYLIHWPMPAQGQYVETWKALVELKKSGRVKSIGVSNFESEHLERIMDATGVVPVVNQIELHPDFQQRALREFHEKHNIRTESWRPLGKGRVLSDERIGKIAEKHSRTPAQVVIRWHLQNGLIVIPKSVNPKRLAENLDVFGFVLDADDMQAIEQMDRKDGRMGADPNTAKF

SEQ ID NO: 8574 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGTELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8575 - protein, 455 aa, Solanum tuberosum
KAYDSDPFHPLKNPNGVIQMGLAENQLCLDLIEDWIKRNPKASICSNEGIKSFRAIANFQDYHGLPEFRRAIAKFMEKTRGGRVRFDPERVVMAGGATGANETIIFCLADPGDAFLVPSPYYPAFNRDLRWRTGVQLLPIHCESSNNFKITSKAVKEAYENAQKSNIKVRGLILTNPSNPLGTTLDKYTLKSLLSFTNQHNIHLVCDEIYAATVFDTPQFVSIAEVLDEKEMTYCNKDLVHIVYSLSKDMGLPGFRIGIVYSFNDDVVNCARKMSSFGLVSTQTQYFLAAMLSDEKFVDNFLTESAIRLAKRHKHFTNGLEEVGIKCLKNNAGLFCWMDLRPLLRESTFDSEMSLWRVIINDVKLNVSPGSSFECQEPGWFRVCFANMDDGTVDIALARIRRFVRVEKSGDESSAMEKKQQWKKNNLRLSFSKRMYDESVLSPLSSPIPPSPLVR

SEQ ID NO: 8576 - protein, 181 aa, Brassica napus
GGYFEMTNFPPRVVEEIYKVASIALSPNVSAQIFMGLMVSPPKPGDISYDQFARESKGILESLRRRAKIMTDGFNSCKNVVCNFTEGAMYSFPQIKLPPGALQAAKQAGKVPDVFYCLKLLEATGISTVPGSGFGQKEGVFHLRTTILPAEEEMPEIMDSFKKFNDEFMTQYENSFGYSRM

SEQ ID NO: 8577 - protein, 856 aa, Cytophaga hutchinsonii
MNLSIRTLNIIFSISLLLLASAFIYSYLNIQGLRSANHWVNHTNKVIISLESIYSDIKNAESGVRGYALTKDASYLEQQDQSRTNIKNQLILLDSLLADNPEQHIYIDTLQKTVNDRFFLFNGLINLTNNNADQAEVLPLMQKGKASTEHIYNLVKKMKNNEGILLLQRNEKAEALDKTTPITIVFSGIFGFMVLVISYYFILADLKQRRKIANEVKIKNTLLEYAQQITQMGTFEYNVFTNTLFWSNEMYNIFELDRSVIPEINFIDSLIKEESEITHNRRKKNFQPGASYSDELKIRTVNGNEKVLISNGYVVNEENGLVVHGAIIDITPLKKAELTAREQQELMRVAKEKAESASQFKTRFLSNMSHEIRTPINAILGFTAILSKQELTEQQKKLLKNISISGELLLKLIGNILDISKIEEGKVIIESKSFHLKESIRSVLSPFQHSASEKGLQFHLIIDKSIPDYLLGDFPRISQVLVNLIGNALKFTSHGNITVSVLLTKKQDGLSFVEFVINDTGIGIQANKQDEIFESFTQANESISVKYGGSGLGLSIVQEVVHLMGGNIQVQSPAHYNERGKGYGSKFFFTLPFKLGEKGADPQAKKTAVQPFPRVLHILVADDNEMNRTLATYTLQSLGCTFEIVENGLQAIQKAAANTYDIILMDMQMPVCDGLQATRQIRLNKNTTPIVGLTANVFQEDINRCLDAGMDGHLGKPYTEEDLYHIIDKWVFKNEKNIAASVPSFSNYEFIEKLSKNDPVIFREMLEMFLNQNAQLLKIIHTAINAEDLETLSFNVHQYKSCARMLNIEKQISLIKQIEEKIEARVSLETIRTDIMQLIETGALVSKEIEQKLLIV

SEQ ID NO: 8578 - protein, 551 aa, Ehrlichia ruminantium
MANMVVTGEQLDKSIREVVRILEDAVGCTAGPKGLTVAISKPYGAPEVTKDGYKVMKSIKPEDPLALAIANIIAQSASQCNDKVGDGTTTCSILTAKVIEEVSKVKAAGADIICVREGVLKAKEAVLEALKCMKREVLSEEEIAQVATISANGDKNIGTKIAQCVKEVGKDGVITVEESKGFKELDVEKTDGMQFDRGYLSPYFVTNSEKMLVEFENPYILLTEKKLNIIQPLLPILENIARSGRPLLIIAEDVEGEALSTLVLNKLRGGLHVAAVKAPGFGDRRKDMLGDIAILTGAKHVINDELAIKMEDLTLCDLGTAKNIRITKDTTTIIGSVDNSCAHVQSRICQIRMQIDNSTSDYDKEKLQERLAKLSGGVAVLKVGGSSEVEVKERKDRVEDALHATRAAVEEGVVPGGGAALLYTLSALDNLKSKNDDEQLGINIVKRALQAPIKRIIKNAGSENAPCVIAHLLKQNDKELIFNVDVTNFANAFTSGVIDPLKVVRIAFDFAVSLAAVFMTLNAIVVDIPSKDDNSAAGGAGMGGMGGMGGF

SEQ ID NO: 8579 - protein, 459 aa, Lactobacillus johnsonii
MNKHKMPKDFFWGNSVSSMQTEGAWDEDGKGLSVYDVRPATENTTDWHTAIDEYHRYDEDLDLMKEMNMNMYRIQISWSRVCPEGDGDFNPKGIEFYDKLVDAMLDRGIEPMICLYHFDMPLHLAKEYNGFMSRHVVDAFVRFGKKMIDHFSDRVKYWIVFNEHNLYFQDEVFNISGYEKGDKTLDDMYTIFHHTMISHIRLANYIHEKYDDVKIGGMLAFQQIYPETSKSTDVWAAKQIQEFLNFNIYDADTGRGYSPEVLQYAKNHNINLDITKEDKEEMKKAKADFLAFSYYSSWTVSADKIPADVAPNRYMNYGGVENKYLKTNAWGWTIDPLGFRNAITTMYNHYKIPVFPIENGIGLKETWDSEHMIEDDERIAYHEEHIKAMKDAMFLDGAKVLGYLGWGLIDIPSSHADMEKRYGAVYVNRSNHDLKDLKRVPKKSFYWFQKVLKDNGDEI

SEQ ID NO: 8580 - protein, 128 aa, Arabidopsis thaliana
  misc_feature (106)..(106): Xaa can be any naturally occurring amino acid
MQKRAYFQRQWFYKFLRRTIAVHILMFWTILYLYGGLPYLTCGGGVGIFIGYHVTWLVNSACHIWGSRSWNTKDTSRNVWWLSLFTMGESWHNNHHAFESSARQGXEWWQIDITWYLIRLFEVLGIAT

SEQ ID NO: 8581 - protein, 446 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKTEEKEPSK

SEQ ID NO: 8582 - protein, 686 aa, Triticum aestivum
MLCLSSSLLPRPSAAADRPLPGIIAGGGGGKRLSVVPSVPFLLRWLWPRKAKSKSFVSVTARGNKIAATTGYGSDHLPIYDLDLKLAEFKDHFDYTRNRYIEQKHLIEKHEGSLEEFSKGYLKFGINTEHGASVYREWAPAAEEAQLVGDFNNWNGSGHKMAKDNFGVWSIRISHVNGKPAIPHNSKVKFRFRHHGVWVEQIPAWIRYATVTASESGAPYDGLHWDPPSSERYVFNHPRPPKPDVPRIYEAHVGVSGGKLEAGTYREFPDNVLPCLRATNYNTVQLMGIMEHSDSASFGYHVTNFFAVSSRSGTPEDLKYLIDKAHSLGLRVLMDVVHSHASNNVIDGLNGYDVGQSAHESYFYTGDKGYNKMWNGRMFNYANWEVLRFLLSNLRYWMDEFMFDGFRFVGVTSMLYNHNGINMSFNGNYKDYIGLDTNVDAFVYMMLANHLMHKLFPEAIVVAVDVSGMPVLCWPVDEGGLGFDYRQAMTIPDRWIDYLENKGDQQWSMSSVISQTLTNRRYPEKFIAYAERQNHSIIGSKTMAFLLMEWETYSGMSAMDPDSPTIDRAIALQKMIHFITMAFGGDSYLKFMGNEYMNAFVQAVDTPSDKCSFLSSSNQTASHMNEEEKGSALTKGYTHLRSGCFDPSLPSTSSCAFLGPSNQSPFSKPFIGFPGCIFCCGLFKGE

SEQ ID NO: 8583 - protein, 80 aa, Zea mays
  misc_feature (17)..(17): Xaa can be any naturally occurring amino acid
  misc_feature (23)..(23): Xaa can be any naturally occurring amino acid
  misc_feature (32)..(32): Xaa can be any naturally occurring amino acid
  misc_feature (45)..(46): Xaa can be any naturally occurring amino acid
  misc_feature (54)..(55): Xaa can be any naturally occurring amino acid
  misc_feature (62)..(62): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(69): Xaa can be any naturally occurring amino acid
  misc_feature (76)..(76): Xaa can be any naturally occurring amino acid
  misc_feature (79)..(79): Xaa can be any naturally occurring amino acid
HASSNTLDGLNGFDGTXTHYFHXGPRGHHWMXDSRLFNYGNWEVXXFLLSNARXXLEEYKFXGXRFXGXTSMMYTXHGXQ

SEQ ID NO: 8584 - protein, 486 aa, Bacillus licheniformis
MSDRAIPRSYRMMEGFGVHTFRFVNEEGKAHFVKFHWKPVLGVHSLVWDEAQTIAGKDPDYHRRDLWEAIERGDEVEYELGVQMIDEEDEFKFDFDILDPTKLWPEEIVPVKIIGKMTLNRNQDNVFAETEQAAFHPGHVVPGIDFTNDPLLQGRLFSYTDTQLIRLGGPNFHEIPINRPVCPFHNNQYDGYHRMTINKGPVAYHKNSLQNNDPAPASEEEGGYVHYEEKVEGKKIRQRSESFNDHYSQAKLFWNSMSPVEKEHIISAFRFEVGKVKSKDVRRQVVHMFNRVDGELAKQIAAGVGVEPPEKDEGSNVTFKSPALSQENTVKLPQTRTVAILAEQGFDDEDLSRVLKEFKKAGIIPDIVSSALGVIEGAGGTEIEVGNTLQTVDSVLYDAVYIPGGQESIERLKLHKAASDFVNEAFGHYKAVGAAGEGVDLLLSAAGAHAASQPGIITSRGDKNKDDFGKKLVEAISGHRHWDRQV

SEQ ID NO: 8585 - protein, 550 aa, Rickettsia typhi
MTTKLIKHGSKAREQMLEGIDILADAVKVTLGPKGRNVLIEQSFGAPKITKDGVTVAKSIELKDKIRNAGAQLLKSAATKAAEVAGDGTTTATVLARALAREGNKLVAAGYNPMDLKRGMDLAVNAVVEEIKRSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVNIKNLGTAKRVTISKENTVIVDGNGDKKNIEDRVLQIKSQIAETTSDYDKEKLQERLAKLSGGVAVLKVGGATEVEVKERKDRVEDALAATRAAVEEGVVAGGGVTLLHASQTLTKLKVENKDQQAGIEIVIEALKDPLKQIVKNAGENGGVVVGKLLEHNDKNYGFNAQDMQYVDMIKAGIIDPAKVVRTALQDAASVASLIITTETLIVDEPSDKEEPMPMRGGMGGMGGMGGMDF

SEQ ID NO: 8586 - protein, 494 aa, Arabidopsis thaliana
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANFFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 8587 - protein, 205 aa, Bacillus licheniformis
MNNNDGRRKVNGHSKDQQLEQYRSDNRGKKMTTNQGLRVSEDEHSLKAGVRGPTLMEDFHFREKMTHFDHERIPERVVHARGFGAHGYFQVYEPMTEYTKAKFLQDPSVKTPVFVRFSTVAGSRGSGDTVRDVRGFATKFYTEEGNYDLVGNNIPVFFIQDAIKFPDLVHAFKPEPNNEMPQASTAHDTFWDFVANNEETAHMIM

SEQ ID NO: 8588 - protein, 115 aa, Zea mays
  misc_feature (44)..(44): Xaa can be any naturally occurring amino acid
  misc_feature (55)..(55): Xaa can be any naturally occurring amino acid
  misc_feature (64)..(64): Xaa can be any naturally occurring amino acid
  misc_feature (81)..(81): Xaa can be any naturally occurring amino acid
  misc_feature (97)..(97): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEXLRFLLSNARWXLEEYKFDGXRFDGVTSMMYTHHGLQXTFTGNFNEYFGFATDXDAXVYLMLXNDLIHGLYP

SEQ ID NO: 8589 - protein, 441 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKTEV

SEQ ID NO: 8590 - protein, 115 aa, Zea mays
  misc_feature (32)..(32): Xaa can be any naturally occurring amino acid
  misc_feature (55)..(55): Xaa can be any naturally occurring amino acid
  misc_feature (64)..(64): Xaa can be any naturally occurring amino acid
  misc_feature (74)..(74): Xaa can be any naturally occurring amino acid
  misc_feature (76)..(76): Xaa can be any naturally occurring amino acid
HASSNTLDGLNGFDGTDTHYFHSGPRGHHWMXDSRLFNYGNWEVLRFLLSNARWXLEEYKFDGXRFDGVTSMMXTXHGLQVTFTGNFNEYFGFATDVDAVVYLMLVNDLIHGLYP

SEQ ID NO: 8591 - protein, 202 aa, Neurospora crassa
MSDSPQSNSKDVEQGAPSPGEEPQMNDPQDPHSSGLNQYEFEVKEQDRWLPIANVARIMKNALPENAKIAKEAKECMQECVSEFISFITSEASEKCQQEKRKTVNGEDILFAMTSLGFENYAEALKIYLSKYREQQNQTNRSENQQNRPSSQGYGAPQGQNQPGQGGFSSNDLGGQQESGDASGYNLYGAQTGHNGGGAEGY

SEQ ID NO: 8592 - protein, 115 aa, Zea mays
  misc_feature (45)..(45): Xaa can be any naturally occurring amino acid
  misc_feature (55)..(55): Xaa can be any naturally occurring amino acid
  misc_feature (64)..(64): Xaa can be any naturally occurring amino acid
  misc_feature (76)..(76): Xaa can be any naturally occurring amino acid
  misc_feature (93)..(93): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVXRFLLSNARWXLEEYKFDGXRFDGVTSMMYTXHGLQVTFTGNFNEYFGXATDVDAXVYLMLXNDLIHGLYP

SEQ ID NO: 8593 - protein, 220 aa, Triticum aestivum
  misc_feature (176)..(176): Xaa can be any naturally occurring amino acid
  misc_feature (182)..(182): Xaa can be any naturally occurring amino acid
  misc_feature (210)..(210): Xaa can be any naturally occurring amino acid
MSPDDVSRKSPVPPPSPPPMDSWARGGRRSRPRGGGGSGSASSGGAAESEEEYLALSLLMLSRGVRGEVEDGGFGGVKGVGAAPTKAQGYECSVCGKVYASYQALGGHKTSHRKPPTPPAASAGGDEASGGAPVEAKVHQCSLCHRTFPSGQALGGHKRLHYEGGAAGDGTGKDKXGRQAKXAALLRDFDLNLPASGVAGDEAESPPPEXKRARLMLLTV

SEQ ID NO: 8594 - protein, 492 aa, Prunus persica
IRSTLDRHTILKTTLVELGRTLGLQECALWMPSRTGMNLQLSHTLNYQIQVGSTVPINLPIINEVFTSSRAIRIPYTCPLARIRPLVGRYVPPEVIALRVPLLNLSNFQINDWPDLSAKSYAIMVLILPTDSTRKWRDHELELVDVVADQVAVALSHAAILEESMRARDQLMEQNVALDLARREAEMAIHARNDFLAVMNHEMRTPMHAIIALSSLLLETELISEQRVMIETVLRSSNLLETLINDVLDLSRLEDGSLELDIRKFNLHGVFREVINLIQPITSVKKLSMSLILSPDLPLCAVGDENRLMQTILNVAGNAVKFTKEGYISIVASVAKPESSRDWRPPEFYPASTDGHFYLRVQVKDSGCGILPQDIPHLFTKFSQPRSGSNRINDGAGLGLAICRRFINTMGGHIWIESEGIDKGSIVAFIVKLGICDNPCDTTAAHQMAPQALPQPQPQPNYGSGDRIAHRPTVSFRDGGYTSSNPRYQRSI

SEQ ID NO: 8595 - protein, 130 aa, Brassica napus
LFTAGLEGYARPLVDRIDTRKVLSNRLYRPSTVSTPYRDHVKDLLTTSKNMSRTVIVDNNPFSFLLQPSNGIPCIAFSAGQPNDTQLLDVLLPLLKQLSEEEDVRPTLYDRFRMPEWFEKQGIPPSCRNP

SEQ ID NO: 8596 - protein, 477 aa, Lactococcus lactis
MLFLKGLTLMTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 8597 - protein, 489 aa, Persea americana
MEWPKSNDHSLLSKMATNDGHGEKSRIFDGWKAYDNDPYHPTTNPQGVIQMGLAENQLCFDLIEEWIKKNPKWSICTAEGASEFKDIALYQDYHGLPAFRSAIAKFMEKVRGGRAKFNPDRIVMSGGATGAHELVAFCLADPGDAFLVPTPYYPGFDRDLRWRTGVQLVPVVCYGKNDFKITRVALEEAYKKAQEDNIRVKGVIITNPSNPLGTVLDRETLRSIAKFVNEKNIHLVCDEIFAATVFNQPDFIGISEILEEEEEEDVQYNLDLFHVVYSLSKDLGFPGFRVGVVYSYNDDVMNCGRKMSSFGLVSTQTQYLIAGMLSDEVFVENFLAESHRRLAARHKFFTKDLDEVGIGCLNSNAGLYCWVDLRRLLKEATVAGEIALWRTIINEVKLNVSPGSSCHSSEPGWFRVCFANMDDETMKEAIKRIRKFVFENRLVGVASGKGPAVAAKSLGCASKLLRDLKIPYPRQCIMSPQSPLVQATT

SEQ ID NO: 8598 - protein, 424 aa, Avicennia marina
MDPYKYCPSSSFNTPHTTTNGGHPVYNDNSSLTVGTRGPVLLEDYQLIDKLAHFTRERIPERVVHARGATAKGFFEVTHDVSHLTCADFLRAPGVQTPLIVRFSTVIHERGSPETLRDPRGFAVKFYTREGNFDIVGNNFPVFFIRDAIKFPDVIHAFKPNPKSHIQESWRILDFCSHFPESLLTFAWFYDDVGIPQDYRHMEGFGVHSYTLINKAGKVNYVKFHWKPTCGVKCLMEDEAVRIGGTNHSHATQDLYDSIAAGNYPEWKLYFQIMDPDQEDRFDFDPLDTTKIWPEDIIPLIPVGRMVLNKNIDNFFAENEMLAFSPHMIVPGINFSNDKMLQTRIFAYGDTQRHRLGPNYLLLPVNAPKCAYHNNHYDGFMNFMHRDEEVDYFPSKYDPTRHAERHPIPNAVITGRRDRVRCFC

SEQ ID NO: 8599 - protein, 483 aa, Persea americana
MGFLRNQQLLSKMATGNGHGENSPFEGWKAYDSNPYHAIKNPDGVIQMGLAENQLSFDLVEDWIKENPESSICTLKGVSQFKDIALFQDYHGLSAFRNAVANFMGKVRGGKVKFNPDRIVMSGGATGAHETMAFCLANPGDAFLVPTPYYAGFDRDLRWRTGVQLIPVVCESSNGFKVTRDALEIAYKKAQEDNIKVKGVLITNPSNPLGTILDRETLKSIVSFINEQNIHLICDEIYAATVFSQPDFISISEILEEGITCNLDLIHVVYSLSKDLGFPGFRVGVIYSYNDDVVNCAREMSSLGLVSTQTQHLLSAMLSDEQFVDKLISESAERLASRHKMFTIELGKVGISCLKSNAGLFCWMDLRALLEKKTVEGEMALWRTIIEKVKLNVSPGSSFHCSEPGWFRVCFANMDDETMKVALDRIIDFVFKPNKKEIMAPKKVQQKWQANLHLRLSLCGRRHEEVTKTPCTMSPHSPLVRAT

SEQ ID NO: 8600 - protein, 289 aa, Salmonella enterica
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYKAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 8601 - protein, 635 aa, Persea americana
MKGCDCIEPQWSSDDLLVKYQYLSDFFIAVAYFSIPLELVYFVQKSAFFPYRWVLTQFGAFIILCGATHFISLWTFTIHSKTVILVMAVAKVSTAVVSCATALMLVHIIPDLLSVKTREMFLKNKAEELDREMVIIRAQEETGRHVRMLTHEIRSTLNRDTILKTTLVELGRTLGLEECALWMPSHNGSSLQLSLTLRYPISVGATVSIQLPIVNKVFNSIHAVIIPHSCPLARIRPLSGKYVPPEVAAVRVPLLYLSNSQVNNWPELSANGYAVMVLMLPSDSARKWHVHELELVEVVADQVAVALSHASILEESMRAQDMLTEQNAALDLARQEAERAICARNDFLAVMNHEMRTPVHAIIALSSLLLETELTPEQRVMVETVLKSSNLLETLINDVLDLSRLEDGSLKLDIGIFNLHAVFREVINLIKPIAAMKKLSLSLMVAPNVPAFAVGDERRLMQIILNVAGNAVKFTKEGQVSVMACVEKQESLADPQALESYPASSDSHFHLRVQIKDSGCRVSPQDIPHLFTKFCICTRSGVNRSQDGSGLGLAICKRFVNLMEGHIWLQSEGLGKGCTATIVVKLGNNGNKTEESTQVVPRAHPKCGVENLSSRNPFLTISSRTQILKKCLLDF

SEQ ID NO: 8602 - protein, 59 aa, Brassica napus
EKFARSLRLSLREVKLSEGYYVMDPEQAVEMVDENTICVAAILGSTLNGEFEDVKLLNE

SEQ ID NO: 8603 - protein, 844 aa, Saccharomyces cerevisiae
MKPYLFDLKLKDTEKLDWKKGLSSYLKKSYGSSQWRTFYDEKATSELDHLRNNANGELAPSSLSEQNLKYYSFLEHLYFRLGSKGSRLKMDFTWYDAEYSSAQKGLKYTQHTLAFEKSCTLFNIAVIFTQIARENINEDYKNSIANLTKAFSCFEYLSENFLNSPSVDLQSENTRFLANICHAEAQELFVLKLLNDQISSKQYTLISKLSRATCNLFQKCHDFMKEIDDDVAIYGEPKWKTTVTCKLHFYKSLSAYYHGLHLEEENRVGEAIAFLDFSMQQLISSLPFKTWLVEFIDFDGFKETLEKKQKELIKDNDFIYHESVPAVVQVDSIKALDAIKSPTWEKILEPYMQDVANKYDSLYRGIIPLDVYEKESIYSEEKATLLRKQVEETETANLEYSSFIEFTNLPRLLSDLEKQFSDGNIFSNTDTQGQLMRDQIQTWCKFIQTNEFRDIEEQMNKIVFKRKQILEILSALPNDQKENVTKLKSSLVAASNSDEKLFACVKPHIVEINLLNDNGKIWKKFDEFNRNTPPQPSLLDIDDTKNDKILELLKQVKGHAEDLRTLKEERSRNLSELRDEINNDDITKLLIINKGKSDVELKDLFEVELEKFEPLSTRIEATIYKQSSMIDDIKAKLDEIFHLSNFKDKSSGEEKFLEDRKNFFDKLQEAVKSFSIFASDLPKGIEFYDSLFNMSRDLAERVRVAKQTEDSTANSPAPPLPPLDSKASVVGGPPLLPQKSAAFQSLSRQGLNLGDQFQNLKISAGSDLPQGPGIPPRTYEASPYAATPTMAAPPVPPKQSQEDMYDLRRRKAVENEERELQENPTSFYNRPSVFDENMYSKYSS

SEQ ID NO: 8604 - protein, 100 aa, Persea americana
PLLGGVRDVPDHNSAETEELARFAVQEHNKKANTRLEFSRVVKAKEQVVAGTMYYITLEVVEAGQKKIYEAKVWVKLWENFKELQEFKPVGDSSSTSSDA

SEQ ID NO: 8605 - protein, 457 aa, Glycine max
  misc_feature (275)..(275): Xaa can be any naturally occurring amino acid
  misc_feature (315)..(315): Xaa can be any naturally occurring amino acid
MFEGLCLKMEKRGNVLMEKYEFGKLLGQGNFAKVYHARDVRTGESVAVKVIDKEKILKIGLVDQTKREISIMRLVKHPNVLQLYEVLATKTKIYFIIEYAKGGELFNKIAKGRLTEDKARKYFQQLVSAVDFCHSRGVYHRDLKPENLLLDENGVLKVADFGLSALVESHRQKDMLHTICGTPAYVAPEVISRRGYDGTKADVWSCGVILFVLLAGHLPFYDLNLMSLYNKIGKADYKCPNWFPFEVRRLLAKILDPNPNTRISMAKVMENSWFXKGFKPKSGQVKREAVDVALVVSDQIFGLCENTSAAVVEAXASSVKPAHFNAFNIISLSAGLDLSGLFAGNVELDDTKFTFMSSASSIMSTMEDIARVLSMEIIKKDGGLLKLERSKEGRKGPLSIDAEIFEVAPSFHLVELKKSSGDTLEYQKILEDLRPALKDIVGVWQGEQHAVARLCTP

SEQ ID NO: 8606 - protein, 491 aa, Arabidopsis thaliana
MGSKLKLYPLLNHSSVFHPDSRYQSAPTMEEEQQQLRVLFAKYEMGRLLGKGTFGKVYYGKEITTGESVAIKIINKDQVKREGMMEQIKREISIMRLVRHPNIVELKEVMATKTKIFFIMEYVKGGELFSKIVKGKLKEDSARKYFQQLISAVDFCHSRGVSHRDLKPENLLVDENGDLKVSDFGLSALPEQILQDGLLHTQCGTPAYVAPEVLRKKGYDGAKGDIWSCGIILYVLLAGFLPFQDENLMKMYRKIFKSEFEYPPWFSPESKRLISKLLVVDPNKRISIPAIMRTPWFRKNINSPIEFKIDELEIQNVEDETPTTTATTATTATTTTTPVSPKFFNAFEFISSMSSGFDLSSLFESKRKLRSMFTSRWSASEIMGKLEGIGKEMNMKVKRTKDFKVKLFGKTEGRKGQIAVTAEVFEVAPEVAVVELCKSAGDTLEYNRLYEEHVRPALEEIVWSWHGDNHNNNIVKSNGNYVSDENSGSDC

SEQ ID NO: 8607 - protein, 255 aa, Brassica napus
GDIHGQYQDLLRLFEYGGYPPSANFLFLGDYVDRGKQSLETICLLLAYKIRYPSKIYLLRGNHEDAKINRIYGFYDECKRRFNVRLWKIFTDCFNCLPVAALIDDKILCMHGGLSPELDNLNQIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 8608 - protein, 183 aa, Zea mays
  misc_feature (106)..(106): Xaa can be any naturally occurring amino acid
MRLTTENINQRVVAAKYAVRGELAVKSEEYRAKIAKGDTGDLPFNEIISANIGNPQQLDQKPITFFRQVASLLENPILLENEEALTKHFGYQTDVIERAKFLLSRXGSVGAYSASTGVPAIRESIAQFIERRDGFPADPEHIYLSAGASSGVNTLLNVICASPKTGILIPIPQYPLYTATLSL

SEQ ID NO: 8609 - protein, 472 aa, Bacillus licheniformis
MKYKTLAQFPKDFLWGASTSAYQVEGAWDEDGKGPSVIDARESYPEGTTDFKVASDHYQRYKEDIALFAEMGFKAYRFSIAWTRIIPDGDGDINPKGIEFYSRLIDELLKYGIEPIVTMYHFDLPNALQKKGGWSDRATIDAFEKYAKVLFESYGDRVKYWLTINEQNMMILHGSALGTLDPNLENPKKELYQQNHHMLVAQAKAIKLCHEMLPEAKIGPAPNIALIYPASSKPEDVLAAFNYNAIRNWLYLDMAVFGRYNTTAWAYMKEKGCTPVIAEGDMDILRSAKPDFIAFNYYTSQTAEASRGDGSDTAARGGDQHLQTGEEGVYRGSSNPHLKKNAFGWEIDPVGFRSTLREIYDRYQLPLIVTENGLGAFDQLEDGDVVNDDYRIDYLKEHIKQIQLAITDGVDVFGYSPWSAIDLISTHQGCSKRYGFIYVNRDEFDLKDLRRIRKKSFYWYKNLIATNGETLD

SEQ ID NO: 8610 - protein, 640 aa, Corynebacterium glutamicum
MCGLLGILTANGNAEAFVPALERALPCMRHRGPDDAGTWHDADAAFGFNRLSIIDIAHSHQPLRWGPADEPDRYAMTFNGEIYNYVELRKELSDLGYTFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAPLAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 8611 - protein, 404 aa, Vibrio vulnificus
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLVPAPDYPLWTAAVALSGGKAVHYLCDEQADWYPDLDDMRKKITPKTRGIVLINPNNPTGAVYSRDFLLEVIEIARQHKLMIFADEIYDKVLYDGAVHTSVATLTDDVLVMTFNGLSKAYRVCGFRGGWMFMTGPKHLAQGYVNGLDMLASMRLCANVPMQHAIQTALGGYQSINELILPGGRLLEQRDRAWELINQIPGVSCVKPKGAMYLFPKIDTKKYSIKDDQKMVFDFLVQEKVLLVQGSGFNWPKPDHFRIVTLPHIEDLETAIGRFERFLHGYSQ

SEQ ID NO: 8612 - protein, 115 aa, Zea mays
  misc_feature (44)..(44): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEXLRFLLSNARWGLEEYKFDGFRFDGVTSMMYTHHGLQVTFTGNFNEYFGFATDVDAXVYLMLVNDLIHGLYP

SEQ ID NO: 8613 - protein, 339 aa, Ustilago maydis
MAANIPSFTLNTGAKLPSVGMGCWQGQPGPGRDNELVDALVRAIKVGYRHLDTATGYRNEAEVGQAVRQSGVARSEIFVTTKLRPGGVHDVVQELENSLNELGIDYIDLWLLHWPQGFTKDDGGFGTGESFGLEHQKHLGPTFNETWAKMEDVFLNSHKGKVKAIGVSNFSIKNLEILAKTSKVTPAVNQIEAHPYLPEHELVKYCKHKSIHVTAYSPLGQYNASIHEDKDLNEIAKKHDVTAATVALSWAVQRGTSVAPKSTNEKRMKQNITLIKLTDEEMKQVDVISQDPTRSTRLNYFVVNKETGTVLGWTMDEMGWEVGFLEEPGKSTKRIAERK

SEQ ID NO: 8614 - protein, 115 aa, Zea mays
  misc_feature (76)..(76): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVLRFLLSNARWGLEEYKFDGFRFDGVTSMMYTXHGLQVTFTGNFNEYFGFATDVDAXVYLMLXNDLIHGLYP

SEQ ID NO: 8615 - protein, 666 aa, Bdellovibrio bacteriovorus
MGIRRFWKYLSVANKLYIVIGVMALLIALELFTLYFAMNSLSSVRAFVAGESMWSKGQKDAVITLHKYARTRDPQFYITFQENVRVPLGDSKARNALEQVPPDTAKAKEGLLQGKVHPDDIPGVISLVLRFHDFKHVKKAIEIWREGDQMTQELIVMGENLHMLIQKNAPESEIFKALNSVDDLNDRLTVLEASFSYTLGEGSRWLENMLMITLIFAVLIVEGTGLFLTISFSRNLSKGLSELNSAAHEVGEGRFDVQVPVRSGDELGQLAESINLMAHHLSSSIGERQQAEQASQLKSLFLANMSHEIRTPLAAIIGFSDLLKESNLDESERLQYVNIIHRTGEHLTRIINDILDLSKVEAGHLEMQSHPVNLNSLLEDLHILMVARVGDKPVHVEFNRRGIVPDMIRTDPLRLRQILTNIIGNAIKFTDQGYVRMTYEISGSNLLFTVKDTGVGISSAQRSNLFQAFSQIDNSVSRKYEGTGLGLVLSRRLAQMMGGDVHLEDSEPGKGCTFIVKISLDIPKIHTQKIVPIKAKEVHLAAQLSSTSILLVDDVEDNRLLIQRMLAKRGANLTLATNGQEGLTKALEKEFDIILMDIQMPVMDGYTATRKLRQAGYSKPIIALTAHAMKDDRERCLEAGCTDYLTKPVQVESLIQTILNYSMETT

SEQ ID NO: 8616 - protein, 171 aa, Oryza sativa
MLGRKQNAQQKGGGGGGRTGGGGGGEIEPVSVDIMEPFMDAISLTAFAAAPSAAAAAAGVPSTASMDWKETAAAHVFMADMPGVRREEVRVEVEEEKVLRISGQRARAAEEKGERWHRVERSSERFVRTVRLPPNANTDGVHAALDNGVLTITIPKDNDRKPHARIIPITN

SEQ ID NO: 8617 - protein, 160 aa, Helianthus annuus
MDIDSLMGFDPLLRNLHYILEATDDNTTGNKSNNSGPSRAYVRDARAMAATPADVKECPNSYVFIVDMPGLKSGDIKVQVERDNVLVISGKRNREEEKEGVKYVRMERRMGKFMKKFALPEDANTDKISAICQDGVLTVTVEKLPPPEPKKPKTIQVQVA

SEQ ID NO: 8618 - protein, 174 aa, Oryza sativa
TGYFAPTLRYGSPDDLKYFIDRCHAANIGVILDWVPGTFPKDDWALARFFDGTALYEHADPRLGEHMDWGTYIFYYGRNEVRSFLLSNAYYWLREFHIDGLRVDAVASMLYLDYSRKDGEWLPNAYGGRENLDVIEFLKQLNVMVGERFPGVLTIAEESTAWPAVSRPVYAGGL

SEQ ID NO: 8619 - protein, 115 aa, Zea mays
  misc_feature (32)..(32): Xaa can be any naturally occurring amino acid
  misc_feature (55)..(55): Xaa can be any naturally occurring amino acid
  misc_feature (64)..(64): Xaa can be any naturally occurring amino acid
  misc_feature (79)..(79): Xaa can be any naturally occurring amino acid
  misc_feature (81)..(81): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMXDSRLFNYGNWEVLRFLLSNARWXLEEYKFDGXRFDGVTSMMYTHHGXQXTFTGNFNEYFGFATDVDAXVYLMLXNDLIHGLYP

SEQ ID NO: 8620 - protein, 115 aa, Zea mays
  misc_feature (55)..(55): Xaa can be any naturally occurring amino acid
HASSNTLDGLNGFDGTDTHYFHSGPRGHHWMWDSRLFNYGNWEVLRFLLSNARWXLEEYKFDGFRFDGVTSMMYTHHGLQVTFTGNFNEYFGFATDVDAVVYLMLVNDLIHGLYP

SEQ ID NO: 8621 - protein, 829 aa, Aegilops tauschii
  misc_feature (388)..(388): Xaa can be any naturally occurring amino acid
  misc_feature (675)..(675): Xaa can be any naturally occurring amino acid
MLCLTAPSCSPSLPPRPSRPAADRPGPGISGGGNVRLSAVPAPSSLRWSWPRKAKSKFSVPVSAPRDYTMATAEDGVGDLPIYDLDPKFAGFKEHFSYRMKKYLDQKHSIEKHEGGLEEFSKGYLKFGINTENDATVYREWAPAAMDAQLIGDFNNWNGSGHRMTKDNYGVWSIRISHVNGKPAIPHNSKVKFRFHRGDGLWVDRVPAWIRYATFDASKFGAPYDGVHWDPPSGERYVFKHPRPRKPDAPRIYEAHVGMSGEKPEVSTYREFADNVLPRIKANNYNTVQLMAIMEHSYYASFGYHVTNFFAVSSRSERQRPQYLVDKAHSLRLRVLMDVVHSHASSNKTDGLNGYDVGQNTQESYFHTGERGYHKLWDSRLFNYANWXVLRFLLSNLRYWMDEFMFDGFRFDGVTSMLYNHHGINMSFAGSYKEYFGLDTDVDAVVYLMLANHLMHKLLPEATVVAEDVSGMPVLCRSVDEGGVGFDYRLAMAIPDRWIDYLKNKDDLEWSMSGIAHTLTNRRYTEKCIAYAESHDQSIVGDKTMAFLLMDKEMYTGMSDLQPASPTIDRGIALQKMIHFITMALGGDGYLNFMGNEFGHPEWIDFPEEGNNWSYDKCRRQWSLADIDHLRYKYMNAFDQAMNALDDKFSFLSSSKQIVSDMNEEKKIIVFERGXLVFVFNFHPSKTYDGYKVGCDLPGKYKVALDSDALMFGGHGRVAHDNDHFTSPEGVPGVPETNFNNRPNSFKILSPSRTCVAYYRVEEKAEKPKDEGAAFLGETALGYIDVEATGVKDAADGEATSGSEKASTGGDSSKKGINFVFLSPDKDNK

SEQ ID NO: 8622 - protein, 515 aa, Methanocaldococcus jannaschii
MCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 8623 - protein, 444 aa, Glycine max
MESKPHVLMQRYELGRLLGQGTFGKVYYARSTITNQSVAIKVIDKDKVMRTGQAEQIKREISVMRLARHPNIIQLFEVLANKSKIYFVIEYAKGGELFNKVAKGKLKEDVAHKYFKQLISAVDYCHSRGVYHRDIKPENILLDENGNLKVSDFGLSALVDSKRQDGLLHTPCGTPAYVAPEVIKRKGYDGYLPFHDPNLIEMYRKISKAELKCPNWFPPEVCELLGMMLNPNPETRIPISTIRENSWFKKGQNIKNKRPVVENNTVSSSSTVLLDQNDCDGLAAEANGESVVPLSINAFDIISRSVGFDLSRFFDESFKKKEARFSSRLPANVIISKLEDIANQLRMKIKKKAAGLLKLESLNEGRKGVLSIDAEIFEVTPCFHMVEVKKSNGDTLEYQKILKEDIRPALQDIVWVWQSDQQLQSQQSEQQQQTDDQQQQQPQS

SEQ ID NO: 8624 - protein, 680 aa, Colwellia psychrerythraea
MTTTAYPHLLAPLDLGFTQLANRVLMGSMHTGLEEERGGFAKLAAFYQARAKGGVGLIVTGGVSPNLRGRIAPFGSELSHFWQANKHKQVTDAVHQYPTKICLQLLHTGRYAYHPFGVAPSKIKSPISPFTPKAMSVRQIKSTIKDYAYSAKLAAKAGYDGVEIMGSEGYLINQFACVRTNKRNDEWGGSIENRMRLAIETIKAVRAKVGENFIIIFRLSMLDLVEGGNSWEEVVTMAKAVEQAGATLINTGIGWHEARVPTIVTSVPRAAFTWVTEKMKKEVSIPLITTNRINTPEVAEEVLATGQADMVSMARPFLADADFVNKAAENKADEINTCIGCNQACLDHVFAQKRASCLVNPMACYETELVIEKAKQVKKLAVIGAGPAGLAFSVYAAERGHHVELFDKISEIGGQFNVAKQVPGKEEFFETLRYFNKQISLLDIKVYLNTEQSAEKLLAAGFDEVVLATGIKPRKLDIKGLEEGYTSNKVLTYLQVLRDKVEVGNKVAIIGAGGIGFDVATYLSEKSLTNDPEAWLKNWGVDKQYLKNGALLSKQDIPKHDPARHITLIQRKTTKVGKGLGKTSGWVHRANLVKQGVTMLAGASYKAITEKGLVIEVDGKEQLLEVDNIIICAGQESNRDLQQKLIDGGLPVHLIGGANVAAELDAKRAIRQAAELAVKI

SEQ ID NO: 8625 - protein, 731 aa, Haemophilus influenzae
MTTAVTQAIIDGFFDASNGDPFATLGMHETERGIEIRTLLPDASRVVVIERESGKEITELDCVDERGFFVGVIPNCRHFFAYQLQVFWGNEAQIVEDPYRFHPMIDDLEQWLLSEGSMLRPYEVLGAHFMECDGVSGVNFRLWAPNARRVSIVGDFNYWDGRRHPMRFHPKSGVWELFLPKVSLGQLYKFELIDCFGNLRLKADPYAFSSQLRPDTASQVSALPNVVEMTEARKKANQGNQPISIYEVHLGSWRRNLENNFWLDYDQIADELIPYVKEMGFTHIEFLPLSEFPFDGSWGYQPLGLYSPTSRFGSPEAFLRLVKRAHEAGINVILDWVPGHFPSDTHGLSAFDGTALYEHADPREGYHQDWNTLIYNYGRNEVKNFLSSNALYWLERFGVDGIRVDAVASMIYRDYSRAEGEWIPNQYGGRENLEAIEFLKHTNWKIHSEMAGAISIAEESTSFAGVTHPSENGGLGFNFKWNMGWMNDTLAYMKLDPIYRQYHHNKMTFGMVYQYSENFVLPLSHDEVVHGKYSLLDKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVFVFERRSSNGERIIVVSNFTPVPRHEYRIGVNIAGEYEEILNTDSMYYQGSNVGNFGYVASENIESHGRENSISVSIPPLATVYLRLKSVE

SEQ ID NO: 8626 - protein, 245 aa, Corynocarpus laevigatus
ALSIAGAVQSQKLAVCAISQLQSLPGGDIKLLCDTVVESVRELTGYDRVMVYKFHEDEHGEVVAESKRADLDPYIGLHYPATDIPQASRFLFKQNRVRMIVNCHASSVRVIQDEELRQPLCLVGSTLRAPHGCHAQYMANMGSIASLAMAVVINGTDEEGTGGRNSMRLWGLVACHHTSARCIPFPLHYACEFLMQAFGLQLNVELQLALQLSEKHVLRTQTLLCDMLLRDSPTGIVTQSPSIMD

SEQ ID NO: 8627 - protein, 458 aa, Bacillus cereus
MGENHDKQRQSLLGKDFNEIGERNEQAILHSQTVGSRGPVLEQDSVLHEALQEFIHEKILERPVHVKGFGAFGYFQTIYPMSEHTKLSFLQHSNEKVPVMVRFSLAVSTKGTPDTARNVRGFSTKFYTKEGIFDLLCNHIPVFSVRDPMRFPETIQALSPSPKNNLLDPNRFWSFVARAPESIHFVVRLYSDNGTAKSLRRIPGHSVNTYVWRNAEGNRKYVKYHWYPFEGVQFITSEEANKLAAENPDYSGKDLYDAIANGKPVEYGLYVQLMDPKDETHLSYDPLDDTKIWDEKAYPLIPVGKMVLNKNPENYMEQVEKVAFSPSNLLDGAELSDDKMLQGRANIYSDSQRRRIGPEFRKLAINQQQDWTPANQITSGDGRYVEGKLERTSIPKQDDFTQAGEFYAKLKLIEKEHLAENLASDLKVISDDIRKVVLGYFHKVSADLVKRIETEIEK

SEQ ID NO: 8628 - protein, 1222 aa, Cytophaga hutchinsonii
MSQEHESSFQDPSRDELIQQVKELQIINANQRPEKILQEAFEKINLLVITIDQDGLIVYANEAFLEVIGWEKQRLLGENWKEFLEPGKDKNKEEHIYTLIKKQGFIDQLKRKFLSKEGDYRTIKFNVVIHHPIGNDVHLTTLIGEDITDKKKVIRALKDSNDQLQDLFENANDLIQVFDLDGKIQFVNRAWKDILQYSDEEILKLNFRDIIAKEQVGVTMEHLNNILAGKKDDKFETVFTSKNGRNIQVICSVNVRYEKEKPVSFRGIFHDNTEHMRAERAQNLYYKISTLAINSDRLDSLLDNIHKELRTIIAVNNFHVALYDRDHNYLNFPYYVDENIGPKPISMKRIVGKGLTEYSLFNEEPTFLYEEDINKLSEAGAIELLGPTPKIWLGVPLRLENRTIGVICVKSHSDRNKYKRRHVELLDFISGQIALVIERKRNEEQIIDKTARLNAIFESSSHLIWSVNRKRGLTSFNQNYANAIFRKYQKYPTIYDEGVTKEVLVLSDPEFHDSIDKKYKDAFNGQPQHFEACNTNQNGEIFWRETYLNPIFLPDGRIDEVSGISHDITEKKQWEITIQESEEKFRNIFESFQDIYYRTDLSGYITMISPSGCELSGYTQEEIIGKHISEFFTTPKQQVNLIREVLKTGRVKNYETNVNIKGGESIQSISNIRLIYNNEGKPIGVDGVARDITFLKKASQELYHAKEIAEKSLKVKENFLANMSHEIRTPMNGVIGMIDLLNETPLMEEQRKYVQTIKKSSETLLNILNDILDLSKIEAGKMQLRLAPISIEQTVEKLHALFYQQATLKNIDLLYSIDSNVPKVVLADETRLLQILSNLTSNAIKFTDQGSVRIQISLQSKKDLVNKIRVNISDTGIGIAQDKLNVLFGYFNQVDNSSSKSYGGTGLGLAISKELSKLMNGEIGVQTEANKGSVFWFTFEANESKRLVEAKVETPNAFSSEKTFKDYPKILLVDDNAINLFVASEILRKAGCEIDTAGNGLEAIQKVKENPYRMVLMDIQMPQMDGIEATAEIRKLNLAYTPPIIAMTAYSMKEDKDRFMVNGMDDYIAKPIKAESLISKVKAWLDSNAAKNGHTATQTSDETAVEIPILDLEVFEKLKSLSGAEIIDQIYKEFENESLEQIVDCKNSLAMGDFHNILNKLHTLKGVSGTLGLIELESISRLVESKLKKGDYPELAVDIEKLSEAHNRFIEHYTFILNSNSK

SEQ ID NO: 8629 - protein, 435 aa, Arabidopsis thaliana
MEEERRVLFGKYEMGRLLGKGTFAKVYYGKEIIGGECVAIKVINKDQVMKRPGMMEQIKREISIMKLVRHPNIVELKEVMATKTKIFFVMEFVKGGELFCKISKGKLHEDAARRYFQQLISAVDYCHSRGVSHRDLKPENLLLDENGDLKISDFGLSALPEQILQDGLLHTQCGTPAYVAPEVLKKKGYDGAKADIWSCGVVLYVLLAGCLPFQDENLMNMYRKIFRADFEFPPWFSPEARRLISKLLVVDPDRRISIPAIMRTPWLRKNFTPPLAFKIDEPICSQSSKNNEEEEEDGDCENQTEPISPKFFNAFEFISSMSSGFDLSSLFESKRKVQSVFTSRSSATEVMEKIETVTKEMNMKVKRTKDFKVKMEGKTEGRKGRLSMTAEVFEVAPEISVVEFCKSAGDTLEYDRLYEEEVRPALNDIVWSRAR

SEQ ID NO: 8630 - protein, 582 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHKFRTGCDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEATPSTPYDPLVLRHTFEQAVIKRLMTDVPFGVLLSGGLDSSLVASVTSRYLANTKAAEQWGSKLHSFCVGLEGSPDLKAAKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALHQYDCLRANKSTFAWGLEARVPFLDKAFINTAMSIDPESKMIKRDEGRIEKWILRRAFDDEEHPYLPKHILYRQKEQFSDGVGYSWIDGLKAHAAKHVTDKMMLNAGNIYPHNTPTTKEAYYYRMIFERFFPQNSARLTVPGGASVACSTAKAVEWDAAWSNNLDPSGRAALGVHISAYENQNNNKGVEIEKIIPMDAAPLGVAIQG

SEQ ID NO: 8631 - protein, 545 aa, Porphyromonas gingivalis
MAKEIKFDMESRDLLKKGVDALPNAVKVTLGPKVRNVILSKTYGAPHITKDGVSVAKEIELECPFENMGAQLVKEVASKTNDDAGDGTTTATILAQSIIGVGLKNVTAGANPMDLNRGIDKSVKSVVTHIAGMAKEVGADFQKIEHVAKISANGDENIGSLIAEAMRKVKKEGVITVEEAKGTDTTVEVVEGMQFDRGYISPYFVTNTDKMEVQMENPFILIYDKKISVLKEMLPILEQTVQTGKPLLIIAEDNDSEALPTLVVNRLRGSLKICAVKAPGFGDRRKAMLEDIAILTGGAVISEETGLNLENTTMDMLGTAEKVRVDKDNTTIVNGAGNKEGIASRITQIKAQIENTTSDYDREKLQERLAKLAGGVAVLYVGAASEVEMKEKKDRVEDPLSPTRPPIEEGTVPGGGTTYIRAIAALEGLKGENEDETTGIEIVKRAIEEPLRQIVANAGKEGAVMVQKVKEGKDDFGYNARTDVFENLYTTGVIDPAKVTRVALENAASIAGMFLTTECVIADKKEDNPAAPAMPGGMGGMGGMM

SEQ ID NO: 8632 - protein, 159 aa, Triticum aestivum
ALPTLYKVLESAIADRGTGSSAQGQVIWIHFGVNSGATRFALENQAVNEATFRCPDELGWKPQRVPIVPSDGSISRTRETTLPVNELTKSLRKIGYDVVPSDDAGRFVCNYVYYHSLRFAEQHGIKSLFVHVPLFLTIDEEVQMHFAASLLEVLASSSN

SEQ ID NO: 8633 - protein, 454 aa, Oryza sativa
MSTTKVKRRVGKYELGRTIGEGTFAKVKFARDTETGDPVAIKILDKEKVLKHKMVEQIKREISTMKLIKHPNVVRIYEVMGSKTNIYIVLEYVTGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEKYDTTLDDVDAVFNDSEEHHVTEKKEEPEALNAFELISMSAGLNLGNLFDSEQEFKRETRFTSKCPPKEIVRKIEEAAKPLGFDVQKKNYKICSPCLTTICMNIPFKLRLEKVKAGRKGNLNVATEILQVAPSLHMVEVRKAKGDTLEFHKFYKNLSRTLKDVVWKSDDLQNQLS

SEQ ID NO: 8634 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIAFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 8635 - protein, 573 aa, Debaryomyces hansenii
MCGIFAAFRQPEVEQFKSKALQYSKRIRHRGPDWSGNVIQNSTILCHERLAIVGLDSGAQPITSEDGNYTLAVNGEIYNHIQLRDEFPSYPYKSLSDCEPIIPLFEKYDVDAPKYLDGMFAWVLYDKKNDRIVASRDPIGITTLYMGKSSKNPKTRYFASELKCLTDECDEIFAFPPGHVYDSNTDEITRYFNPSWWEESSIPSKRVDLKEVRETLELAVRKRLMAEVPYGVLLSGGLDSSLIAAIAARETQKAAAGISKDGIDANKELSGVDEKGSLHSSGWNQLHSFAIGLPGAPDLIAAEKVAHFIGTIHHSHTFTLDEGLDALDDVIYNLETYDVTTIRASTPMYLLSRKIKAQGVKMVLSGEGSDEIFGGYLYFANAPSPKDFHEECVKRVKNLHYADCLRANKSTMAWGLEARVPFLDKQFLEVCMNINPEDKLIKPAEGKIEKYILRKAFDTSDDPNAKPYLPEEILWRQKEQFSDGVGYSWIDGLKDAAEAAISDEQFANPKAEWGTDVPTTKEAYWYRCKFDEIFHSKAAASTVMRWVPKAEWGCHADPSGRFATIHEQKVDQD

SEQ ID NO: 8636 - protein, 524 aa, Enterococcus faecalis
MAKEIKFAEDARAAMLRGVDVLADTVKVTLGPKGRNVVLEKSFGSPLITNDGVTIAKEIELEDHFENMGAKLVSEVASKTNDIAGDGTTTATVLTQAIVREGLKNVTAGANPLGIRRGIELATKTAVEELHNISSVVDSKEAIAQVAAVSSGSEKVGQLIADAMEKVGNDGVITIEESKGIETELDVVEGMQFDRGYLSQYMVTDNDKMEAVLENPYILITDKKISNIQDILPLLEQILQQSRPLLIIADDVDGEALPTLVLNKIRGTFNVVAVKAPGFGDRRKAMLEDIAILTGGTVITDDLGLELKDTTIENLGNASKVVVDKDNTTIVEGAGSKEAIDARVHLIKNQIGETTSDFDREKLQERLAKLAGGVAVVKVGAATETELKELKLRIEDALNATRAAVEEGMVSGGGTALVNVIGKVAALEAEGDVATGIKIVVRALEEPIRQIAENAGYEGSVIVDKLKNVDLGIGFNAANGEWVNMVEAGIVDPTKVTRSALQNAASVSALLLTTEAVVADKPEP

SEQ ID NO: 8637 - protein, 59 aa, Zea mays
  misc_feature (17)..(17): Xaa can be any naturally occurring amino acid
  misc_feature (32)..(32): Xaa can be any naturally occurring amino acid
  misc_feature (45)..(46): Xaa can be any naturally occurring amino acid
  misc_feature (55)..(55): Xaa can be any naturally occurring amino acid
HASSNTLDGLNGFDGTXTHYFHSGPRGHHWMXDSRLFNYGNWEVXXFLLSNARWXLEEY

SEQ ID NO: 8638 - protein, 719 aa, Neurospora crassa
MRVNALLPLSGLIGTALAACPFADPSALGRRAEGGEVDARQRLKEVEVDDNGQFMTTDFGGNIEEQFSLKAGGRGSTLLEDFIFRQKLQHFDHERIPERVVHARGAGAHGIFTSYGDWSNITAASFLGAKDKQTPVFVRFSTVAGSRGSADTARDVHGFATRFYTDEGNFDIVGNNIPVFFIQDAIRFPDLIHSVKPSPDNEVPQAATAHDSAWDFFSSQPSALHTLFWAMSGNGIPRSYRHMDGFGIHTFRLVTEDGKSKLVKWHWKTKQGKAALVWEEAQVLAGKNADFHRQDLWDAIESGNAPSWELAVQLIDEDKAQAYGFDLLDPTKFLPEEFAPLQVLGEMTLNRNPMNYFAETEQISFQPGHIVRGVDFTEDPLLQGRLYSYLDTQLNRHRGPNFEQLPINRPVSGVHNNHRDGQGQAWIHKNIHHYSPSYLNKGYPAQANQTVGRGFFTTPGRTASGVLNRELSATFDDHYTQPRLFFNSLTPVEQQFVINAIRFEASHVTNEQVKKNVLEQLNKISNDVAKRVAVALGLEAPQPDPTYYHNNVTRGVSIFNESLPTIATLRVGVLSTTKGGSLDKAKALKEQLEKDGLKVTVIAEYLASGVDQTYSAADATAFDAVVVAEGAERVFSGKGAMSPLFPAGRPSQILTDGYRWGKPVAAVGSAKKALQSIGVEEKEAGVYAGAQDEVIKGVEEGLKVFKFLERFAVDGDDEE

SEQ ID NO: 8639 - protein, 524 aa, Enterococcus mundtii
MAKELKFAEDARAAMLRGVDKLADTVKVTLGPKGRNVVLEKSYGSPLITNDGVTIAKEIELEDHFENMGAKLVSEVASKTNDIAGDGTTTATVLTQAIVREGLKNVTAGANPLGIRRGIELATKTAVEELHNISTVVDSKEAIAQVAAVSSGSEQVGPLIAYAMEKVRNDGVITIEESKGIETELDVVEGMQFDRGYLSQYMVTDNDKMEAVLENPYLLITDKKISNIQDILPLLEQILQQSRPLLIIADDVDGEALPTLVLNKIRGTFNVVAVKAPGFGDRRKAMLEDIAVLTGGTVITDDLGLELKDATIENLGNASKVVVDKDNTTIVEGSGDKPAIDARVQLIKNQIAETTSDFDREKLQERLAKLAGGVAVVKVGAATETELKELKLRIEDALNATRAAVEEGMVSGGGTALVNVINKVAMIEAEGDVATGIKIVTRALEEPIRQIAENAGYEGSVIVDKLKNVDLGTGFNAATGEWVNMVEAGIVDPTKVTRSALQNAASVSALLLTTEAVVADKPEP

SEQ ID NO: 8640 - protein, 526 aa, Enterococcus cecorum
MAKEIKFAEDARAAMLRGVDKLADTVKVTLGPKGRNVVLEKSFGSPLITNDGVTIAKEIELEDHFENMGAKLVSEVASKTNDIAGDGTTTATVLTQAIVREGLKNVTAGANPLGIRRGIELATKAAVEELHNISAIVDSKEAIAQVGAVSSGSEQVGNYIADAMEKVGNDGVITIEESKGIETELEVVEGMQFDRGYLSQYMVTDNDKMEAVLENPYILTTDKKISNIQEILPLLEQILQQSKPLLIIADDVDGEALPTLVLNKIRGTFNVVAVKAPGFGDRRKAMLEDIAILTGGTVITEDLGLELKDATLQSLGQASKVVVNKDTTTIVEGAGDSENIAARVQIIKGQIAETTSDFDREKLQERLAKLAGGVAVIKVGAPTETELKEMKLRIEDALNATRAAVEEGMVSGGGTALVNVINKVAEAESKETGDVATGVRIVLRALEEPVRQIAENAGYEGSVIVDRLKKEKLGVGFNAATGEWVNMLEAGIVDPTKVTRSALQNAASVAALLLTTEAVVADKPEP

SEQ ID NO: 8641 - protein, 283 aa, Listeria innocua
MKTVKLNNGIEVPILGFGTYQITDAGEAEQAVKEAIAAGYRHIDTAQSYMNEEAVGRGIAASGVDRKELFITTKIWVENVSYKGVMSSFDRSLKRLGLDYIDLLLIHQPYNDVYGAWMAMEELQAQGKIKAIGVSNFGVDRVVDLAAFNDITPQVNQIEINPFQQQSKNIEALRKEGVAVEAWAPFAEGKNDIFTNPILTKIAEKYGKSVAQVILRWLIEQDIIVLAKSVKPERMAQNLAVFDFELSEEDKSAIATLNQGESQFFSHADPEMVKWMASRKINI

SEQ ID NO: 8642 - protein, 245 aa, Corynocarpus laevigatus
ALSIAGAVQSQKLAVCAISQLQSLPGGDIKLLCDTVVESVRELTGYDRVMVYKFHEDEHGEVVAESKRADLDLYIGLHYPATDIPQASRFLFKQNRVRMIVNCHASSVRVIQDEELRQPLCLVGSTLRAPHGCHAQYMANMGSIASLAMAVVINGTDEEGTGGRNSMRLWGLVACHHTSARCIPFPLRYACEFLMQAFGLQLNMELQLALQLSEKHVLRTQTLLCDMLLRDSPTGIVTQSPSIMD

SEQ ID NO: 8643 - protein, 586 aa, Triphysaria versicolor
MCGILAVLGCSDDSQAKRVRVLELSRRLKHRGPDWSGIHHHGDCYLAHQRLAIVDPASGDQPLFNEDKRIAVTVNGEIYNHEELRALLPNHKFRTGSDCDVIAHLYEEYGENFVEMLDGMFSFVLLDSRDNTFIAARDAFGITSLYIGWGLDGSVWISSELKGLHDECENFEVFPPGHVYSSKTEGFRRWYNPPWFSEAIPSTPYDPLVLRGAFEQAVIKRLMTDVPFGVLLSGGLDSSLVAAVTARHLAGTKAAKRWGSQLHSFCVGLEGSPDLKAGKEVADYLGTVHHEFLFTVQDGIDAIEDVIYHIETYDVTTIRASTPMFLMSRKIKSLGVKMVISGEGSDEIFGGYLYFHKAPNKEEFHRETCRKIKALHQYDCLRANKATSAWGLEARVPFLDKEFVNLAMSIDPEAKMIKPDQGRIEKWILRKAFDDEERPYLPKHILYRQKEQFSDGVGYSWIDGLKAHAEQHVTDKMMLNAGHIFPHNTPTTKEGYYYRMIFERFFPQNSAKLTVPGGPSVACSTATAVAWDASWSKNLDPSGRAATGVHDLAYENHVPIGNLKSKKMDSVSLGNAVGPQELTIRS

SEQ ID NO: 8644 - protein, 89 aa, Zea mays
  misc_feature (45)..(45): Xaa can be any naturally occurring amino acid
  misc_feature (64)..(64): Xaa can be any naturally occurring amino acid
  misc_feature (74)..(74): Xaa can be any naturally occurring amino acid
HASSNTLDGLNGFDGTDTHYFHSGPRGHHWMWDSRLFNYGNWEVXRFLLSNARWGLEEYKFDGXRFDGVTSMMXTHHGLQVTFTGNFNE

SEQ ID NO: 8645 - protein, 546 aa, Geobacter metallireducens
MAKIIKFDQEGRNAILKGVNTLADAVKVTLGPKGRNVIIEKSFGSPLITKDGVTVAKEIELEDKFENMGAQLVKEVASKTSDVAGDGTTTATVLAQAIYRQGSKLVAAGHNPMEIKRGIDSAVETIVAELQKISKPIKDHKEIAQVGTISANNDKTIGGIIAEAMEKVGKEGVITVEEAKAMETSLETVEGMQFDRGYLSPYFVTDPERMEASLENANILIHDKKISNMKDLLPILEQTAKSGRPLLIIAEDIEGEALATLVVNKLRGVLNICAVKAPGFGDRRKAMLEDIAVLTGGKVISEELGFKLENATFDMLGTAKRVTIDKDNTTIIDGDGSEADIQGRVKQIRAQIEETSSDYDREKLQERLAKLVGGVAVIKVGAATETEMKEKKARVEDALHATRAAVDEGIVPGGGVAYIRSLGALEGISLPAEQQFGVTLIKRALEEPIRQIAQNAGVDGSIVVDKVKNGKDAFGFNAADDEYVDMIAAGIIDPTKVSRSALQNAASVAGLMLTTEAMIADKPKEEAAMPAMPGGMGGMGGMGGMM

SEQ ID NO: 8646 - protein, 374 aa, Crossosoma bigelovii
ALSIAGAVQSQKLAVRAISHLQSLPSGDIKLLCDTVVENVRELTGYDRVMVYKFHEDEHGEVVAESKRPDLVPYIGLHYPATDIPQASRFLFRQNRVRMIVDCNATPVKVIQDESLMQPLCLVGSTLRAPHGCHAQYMANMGSNASLAMAVIINGNEEEGVGGRSPMKLWGLVVCHHTSARCIPFPLRYACELLMQALGPQLNMELQLASQSSEKRVLRTQTLLCDMLLRDSPTGIVTQSPSIMDLVKCDGAALYYQGKYYPLGVTPTEPQIKDIVEWLLAFHGDSTGLSTDSLADAGYQGAATLGDAVCGMAVAYITKRDFLFWFRSHTAKEIKWGGAKHHPADKDDGQRMHPRSSFKAFLEVVKSRSLPWEN

SEQ ID NO: 8647 - protein, 245 aa, Eucryphia billardieri
ALSIAGAVQSQKLAVRAISQLQSLPGGHIKLLCDTVVESVRELTGYDRVMVYKFHEDEHGEVVAESKRPDLEPYIGLHYPATDIPQASRFLFKQNRVRMIVDCHATPVRVIQDEGLIQPLCLVGSTLRAPHGCHAQYMANMGSTASLAMAVIINGNDEEAIGGRNSMRLWGLVVCHHTSARSIPFPLRYACEFLMRAFGLQLNMELQLALQLSEKHILRTQTLLCDMLLRDSPTGIVTQSPSIMD

SEQ ID NO: 8648 - protein, 376 aa, Triticum aestivum
MDTSGGGTAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 8649 - protein, 279 aa, Enterococcus faecalis
MITSLADTVTLNNGTKIPGMGLGVFQIPDEETAKVVEEGIINGYRLIDTAQIYGNESGTGAGIKAGLAATGLNREDLFVTSKVWNAHISYDETIQAFNDSLERLGLDYLDLYLIHWPGNNSYKESWQALETLYAEGKVKAIGVSNFQVHHLEDLLSYAKVVPVINQVELHPKLDQKEVRDFCEKHDIKVQAWSPLMQGQLLSNETILAIAENHNKSAAQVILRWDIQQDILLAVKSVHKERMISNAAVFDFELSAEEMAQINQLNESLRVGPDPDTFDF

SEQ ID NO: 8650 - protein, 508 aa, Xanthomonas axonopodis
MRVAVLSVALSLALFASPGWAQKAGPAAAQASADDPEANEAAVSKVPLDEIRRFVAVYNAVKQAYVDPVEDKKLMHAAVRGLLSDLDPHSTYFDKEDAEAFDEQATGAYDGIGVELLQQQDNTLKVIAPIDDTPAARAGIRAGDVIVAIDGKPIDASKAMEPLRGESGSKVVLTIMRDKMPKPFDVTLQRETIRVASVRSKLLEPGFGYIRISTFQADTGADFQKNLKQLQAGGKLRGLVLDLRSNPGGLLTSAVQVADDLLDKGNIVSTRGRISISDAKFDATPGDLLNGAPVVVLVDAGSASASEVLAGALRDNKRARIIGSRTFGKGSVQTVLPLDNGDSVKLTTARYYTPSGKSIQASGIVPDVLLTPEPQPGDADVPASLTDYSEATLPGHLRGDDEGEEGYSAGDVLPGDGPITEALAELKQPGAAAKAQAARKAKAQAAQKAKAANKTGAEPKPAAARPATTDKPRSAEPAGKAKPATTPPAPAEPVQPTTPTDKPAEPVN

SEQ ID NO: 8651 - protein, 245 aa, Eucryphia billardieri
ALSIAGAVQSQKLAVRAISQLQSLPGGHIKLLCDTVVESVRELTGYDRVMVYKFHEDEHGEVVAESKRPDLEPYIGLHYPATDIPQASRFLFKQNRVRMIVDCHATPVRVIQDEGLIQPLCLVGSTLRAPHGCHAQYMANMGSTASLAMAVIINGNDEEAIGGRNSMRLWGPVVCHHTSARSIPFPLRHACEFLMQAFGLQLNMELQLALQLSEKHILRTQTLLCDMLLRDSPTGIVTQSPSIMD

SEQ ID NO: 8652 - protein, 245 aa, Aleurites moluccana
ALSIAGAVQSQKLAVRAISRLQSLPGGDIKLLCDTVVECVKELTGYDRVMVYKFHEDEHGEVVAESKRPDLEPYIGLHYPSTDIPQASRFLFKQSRVRMIVDCHATAVSVIQDEALMQPLCLVGSTLRAPHGCHAQYMANMGSIASLAMAVIINGNDEEAIGGRNSMRLWGLVVCHHTSARSIPFPLRYACEFLMQAFGLQLNMDLQLASQFSEKHVLRTQTLLCDMLLRDSPTGIVTQSPSIMD

SEQ ID NO: 8653 - protein, 555 aa, Vibrio fischeri
MCSIFGILDIKSDPTPLRTTALEMSKKLRHRGPDWSGIYSSDKAILAHERLAIVGLNSGAQPLYSEDKKHILAVNGEIYNHKELREKYADNYTFQTDSDCEVILALYREKGADLLEDLNGIFAFILYDEEKDEYLIGRDHIGIIPMYHGYDEHGNYYVASEMKALVPVCKSISEFPPGHFYSSKDTEPTRYYLRDWMDYDAVKDNPTSKEDLTQALEDAVKRQLMTDVPYGVLLSGGLDSSITSAVAKRFAAMRIEDDEKSEAWWPQLHSFAVGLEGAPDLKAAREVADKLGTVHHEMTYTIQEGLDAIRDVIYHIETYDVTTIRASTPMFLMGRKIKAMGIKMVLSGEGADEIFGGYLYFHKAPNKKEFHEETVRKLLALNMFDCARANKSLAAWGVEGRVPFLDKEFIDVAMRLNPQDKMCGNGKMEKHILRECFEHYLPEAIAWRQKEQFSDGVGYSWIDTLRETAEAKVTDQQMESAKFRFPYNTPTTKEAYVYREIFEELFPLEDAAKCVPGGPSVACSSAKAIEWDESFQNCVDPSGRAVQAVHNEAYD

SEQ ID NO: 8654 - protein, 542 aa, Lactococcus lactis
MSKEIKFSSDARTAMMRGIDILADTVKTTLGPKGRNVVLEKSYGSPLITNDGVTIAKEIELEDHFENMGAKLVSEVASKTNDIAGDGTTTATVLTQAIVREGLKNVTAGANPVGIRRGIELAAETAVASIKEMAIPVHDKSAIAQVATVSSRSEKVGEYISDAMERVGSDGVITIEESKGMQTELDVVEGMQFDRGYLSQYMVSNTEKMVAELDNPYILITDKKISNIQEILPLLEQILKTNRPLLIVADDVDGEALPTLVLNKIKGVFNVVAVKAPGFGDRRKAQLEDLAILTGGTVITEELGLDLKDATLEALGQAAKATVDKDHTTIVEGAGSVGAISDRVAIIKAQIEKITSDFDREKLQERLAKLAGGVAVVKVGAATETELKAMKLLIEDALNATRAAVEEGIVSGGGTALVNAIAALDKLSEEGDIQTGINIVRRALEEPVRQIAANAGYEGSVIIDKLRSEKVGTGFNAATGQWVNMIEEGIVDPAKVTRSALQNAASVAGLILTTEAVVANKPEPAAPAMPPMDPSMGMGGMM

SEQ ID NO: 8655 - protein, 466 aa, Escherichia coli
MDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 8656 - protein, 909 aa, Bdellovibrio bacteriovorus
MTLRLRIFLFNLISVFLATFVVALIGLKIVESTVIDSTYERLTQIRISKTSSIENYFRDLQTAINLISSHELTDDLLRERKVDSLPEFRRLLDNYVLDFNIYDMALINNQGVVVYTTRKDIEDGASVTTDLPQGSKLKDIYTWGVKAQEGSTLFLDFDKDTLNPNSATGFVASPIYRNLRPVGVLVLKISISEIDRITSDNFAWPTHGMGQTGETLIYGEDWSLRNTGRFRVEANQSAQGSLEAEVLSSNRGDEDIKKIENLSEVRELGTDYRGQKVIRSIGKIYLPNGELWYIQTKIDESEAFAVLDRIAIASSAAAVLIFILFFFATFAATGKVVEPIQLLTDRLEKLGTSNLTQKINYNSKDEIGLLVSKYNQLADRLETTTVSKEFLDSVIQSIKAFLFIVKVSHHDDWRQASYMISQANESALKFLGYSLNQISHVDLKQLINTQEEFNNYTWLLQTRLSIEAEITAQDGRRLPILMNWAALPNRTSKDLTFVFVCTDITDRITAEQALIEAREQAVKASQAKSEFLARMSHEIRTPLNAIIGITDILAESDLKPEQSQLVRVCANAGENLLALINDILDISKIEAREVRLEKIAFDLESTTTNICDILKQKATEKDLKFSLTVNLPKNRAPLVIGDPTRLRQILFNLIGNAIKFTQEGEIAVLLDFDSSSQKFVRFTIRDTGTGIPKDKQHLLFQSFVQADSSITRKFGGSGLGLTISKNLVELMGGRIWFQSEEGSGSSFYFTVPYVPTEAPRELAAPEKTQAAETTPRPTMNELTVTRSARILVVDDTEDNRFLLLTYLKKLPFEVVQAENGKEAVEKVLAEPFDLILMDIQMPVMDGYAATRKIRQWEKDQGLKPIPIIAVSANAMAEDMQKSLDVGCSEHVTKPIKKSALLEMIHRYLG

SEQ ID NO: 8657 - protein, 325 aa, Shewanella oneidensis
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 8658 - protein, 524 aa, Vagococcus fluvialis
MTKDIKFSEDARSSMMRGVDTLADIVKVTLGPKGRNVVLDKSFGSPLITNDGVTIAKEVELEDRFENMGAQLVAEVASKTNDIAGDGTTTATVLTQAIVREGLKNVTAGANPIGIRRGIELATKKAVEELHALSKQVDSKEAIAQVAAVSSGSDTIGELISEAMDKVGNDGVITIEESKGIETELDVVEGMQFDRGYLSQYMVTDNDKMEAVLDNPYLLITDKKISNIQDILPLLEQILQQSRPLLIIADDVDGEALPTLGLNKIRGTFHVVAVKALAFGDRRKAMLEDIAILTGGTVLTDDLGLELKDAPFETLGMAFKVVENKDIPRIVKGSGEKRTIERLVPLIKNPIGEPTSDFDREKLQERLVKLAGEVAVVKVEAATETELKELKLRIEDALNATRAAVEEGIVPGGGTAFVNVLPKFAEIDATGDEATGVKIVLRALEEPVRQIAENAGLEGSVIVDKLKQAQPGVGYNAKTDEWVNMIDAGIVDPTKVTRSALQNAASVSALLLTTEGVIADKPSN

SEQ ID NO: 8659 - protein, 340 aa, Brucella suis
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEELDILGEYFVK

SEQ ID NO: 8660 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLREPRGFAVKFYTREGNFDLVGNNMPVFFIRDGMKFPDMVHAFKPSPKTNMQENWRIVDFFSHHPESLHMFSFLFDDVGIPLNHRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 8661 - protein, 552 aa, Wolbachia sp.
MANIVVSGEQLQEAFREVAAMVDSTVGATAGPRGNTVGISKPYGGPEVTKDGYKVMKGIKPEKPLHSAIVSTIAQSASQCNDKVGDGTTTCSILTSNMIMEASKSIAAGNDRICIKNGIQKAKDVILKEITSMSRTISLEKMDEVAQVAIISANGDKDIGNSIADAVKKVGKEGVITVEESKGSKELEVELTTGMQFDRGYLSPYFVTNNEKMSVELDDPYLLITEKKLNIIQPLLPILEAIFKSGKPLFIIAEDVEGEALSTLVINKLRGLKVAAVKAPGFGDRRKEMLEDIAALTGAKYVIKDELGIKMEDLTLEDLGTAKNVKITKDNTTIVSEDSDCDKQNRVNARINQIKSQIETSTSDYDKEKLRERLAKLSGGVAVLKVGGATEVEVKERRDRVEDALHATRAAIEEGIVPGGGVALLYAASALDKLKASSDEEQIGINIVKKVLSAPIKRLVKNAGLESAVIIDYLIKQNDKELIYNVEAMNYANASTAGVIDPAKVVRIAFETAVSVASALITTESMIVDLPNKEENASSPMGAGAMGGMGGF

SEQ ID NO: 8662 - protein, 115 aa, Zea mays
  misc_feature (106)..(106): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLXNDLIHGLYP

SEQ ID NO: 8663 - protein, 115 aa, Zea mays
  misc_feature (74)..(74): Xaa can be any naturally occurring amino acid
HASSNTLDGLNGFDGTDTHYFHSGPRGHHWMGDSRLFNYGNWEVLRFLLSNARWGLEEYKFDGFRFDGVTSMMXTHHGLQVTFTGNFNEYFGFATDVDAGVYLMLVNDLIHGLYP

SEQ ID NO: 8664 - protein, 303 aa, Unknown
  Synechococcus sp. CC9605
MVSSQTADTRELRQRAAVMSPRDRLPARQRKFKMGTTSFMLVMHVLATVALLPHFWSWQGVVAFGVLYWLTVLGVTLGLHRLVAHRSLVVPVWVERILVLMGTLACQSGPIEWVGLHRHHHRFSDQPTDHHDAGRGLWWAHSEWMLHDIPALKELDRYAGDLQCDPFYRWLDRWFLLLQIPLGLGLYWFGEAAQVHGGGLGLVLWAIPLRLVVVYHVTWLVNSATHAFGYRNFDCPDLSRNCWWVALLSFGEGWHNNHHAHPASARHGLRWFEFDLTWQHVRLLKRLGLASRIRTARYVPGAS

SEQ ID NO: 8665 - protein, 115 aa, Zea mays
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMWDSRLFNYGNWEVLRFLLSNARWGLEEYKFDGFRFDGVTSMMYTHHGLQVTFTGNFNEYFGFATDVDAXVYLMLXNDLIHGLYP

SEQ ID NO: 8666 - protein, 722 aa, Aspergillus nidulans
MRALGLVGLVGVANAVCPYMTGELGRRDTNPDATEATEEFLSEYYLDDTDSYLTTDVGGPIEDQQSLKAGARGSTLLEDFIFRQKIQRFDHERVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWELNVQIMDEEDQLRFGFDLFDPTKIVPEEYVPLTPLGKMTLNRNPRNYFAETEQVMFQPGHVVRGVDFTEDPLLQQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFENANVKSDVVKNNVIVQLNRISNDLATRVAKAIGVDAPEPDNTYYHDNTTSNIGAFGHRLQSLAGLKIAVLASVDAEESFSAATALKAELSNDNLDVIVVAERFSNGVNQTYSASDAIQFDAVVVAPGAEKLFGAKSAANSSSTLYPAGRPLEILVDAFRFGKPVAALGSGSTAFDNAGINTAVEGVYVADAVDESFANNLEEGLTVFKFLDRFALDSDE

SEQ ID NO: 8667 - protein, 245 aa, Aleurites moluccana
ALSIAGAVQSQKLAVRAISRLQSLPGGDIKLLCDTVVECVKELTGYDRVMVYKFHEDEHGEVVAESKRPDLEPYIGLHYPSADIPQASRFLFKQSRVRMIVDCHATAVSVIQDEALMQPLCLVGSTLRAPHGCHAQYMANMGSIASLAMAVIINGNDEEAIGGRNSMRLWGLVVCHHTSARSIPFPLRYACEFLMQAFGLQLNMDLQLASQFSEKHVLRTQALLCDMLLRDSPTGIVTQSPSIMD

SEQ ID NO: 8668 - protein, 115 aa, Zea mays
  misc_feature (32)..(32): Xaa can be any naturally occurring amino acid
  misc_feature (45)..(45): Xaa can be any naturally occurring amino acid
  misc_feature (55)..(55): Xaa can be any naturally occurring amino acid
  misc_feature (64)..(64): Xaa can be any naturally occurring amino acid
  misc_feature (100)..(100): Xaa can be any naturally occurring amino acid
  misc_feature (106)..(106): Xaa can be any naturally occurring amino acid
HASSNTLDGLNGFDGTDTHYFHSGPRGHHWMXDSRLFNYGNWEVXRFLLSNARWXLEEYKFDGXRFDGVTSMMYTHHGLQVTFTGNFNEYFGFATDVDAXVYLMLXNDLIHGLYP

SEQ ID NO: 8669 - protein, 245 aa, Goupia glabra
ALSIAGAVQSQKLAVRAISQLQSLPGGDIKVLCDTVVESVRELTGYDRVMVYKFHEDEHGEVVAENKRPDLEPYIGLHYPSTDIPQASRFLFKQNRVRMIVDCHATPVRVIQDKGLMQPLCLVGSTLRAPHGCHAQYMANMGPTASLAMAVIITGNDEEAIGGRNSMRLWGLVVCHHTSARCIPFPLRYACEFLMQAFGLQLNMELQLASQLSEKRVLRTQTLLCGMLLRDSPTGIVTQSPSIMD

SEQ ID NO: 8670 - protein, 544 aa, Chlamydia trachomatis
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVDQIRKISKPVQHHKEIAQVATISANNDAEIGNLIAEAMEKVGKNGSITVEEAKGFETVLDIVEGMNFNRGYLSSYFATNPETQECVLEDALVLIYDKKISGIKDFLPVLQQVAESGRPLLIIAEDIEGEALATLVVNRIRGGFRVCAVKAPGFGDRRKAMLEDIAILTGGQLISEELGMKLENANLAMLGKAKKVIVSKEDTTIVEGMGEKEALEARCESIKKQIEDSSSDYDKEKLQERLAKLSGGVAVIRVGAATEIEMKEKKDRVDDAQHATIAAVEEGILPGGGTALIRCIPTLEAFLPMLTNEDEQIGARIVLKALSAPLKQIAANAGKEGAIIFQQVMSRSANEGYDALRDAYTDMLEAGILDPAKVTRSALESAASVAGLLLTTEALIAEIPEEKPAAAPAMPGAGMDY

SEQ ID NO: 8671 - protein, 447 aa, Zea mays
  misc_feature (141)..(141): Xaa can be any naturally occurring amino acid
  misc_feature (256)..(256): Xaa can be any naturally occurring amino acid
MSAAATKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKXNLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLNLLTRLVEQSXENSCDFRITIPEILEDEWFKKGYKRPEFDEKYDTPLDDVDAVFNDSEEHHVTEKKEEEPVALNAFELISRSAGLNLGNLFDSEQEFKRETRFTSKCPPKEIIRKIEEAAKPLGFGVQKKNYKLRLEKVKAGRKGNLNVATEILQVAPSLHMVQVRKAKGDTLEFQKFYKNLSKTLKDVVWKSEDLQMRAAS

SEQ ID NO: 8672 - protein, 245 aa, Goupia glabra
ALSIAGAVQSQKLAVRAISQLQSLPGGDIKVLCDTVVESVRELTGYDRVMVYKFHEDEHGEVVAENKRPDLEPYIGLHYPSTDIPQASRFLFKQNRVRMIVDCHATPVRVIQDKGLMQPLCLVGSTLRAPHGCHAQYMANMGSTASLAMAVIITGNDEEAIGGRNSMRLWGLVVCHHTSARCIPFPLRYACEFLMQAFGLQLNMELQLASQLSEKRVLRTQTLLCDMLLRDSPTGIVTQSPSIMD

SEQ ID NO: 8673 - protein, 220 aa, Populus tremuloides
MVRGKTQMRRIENATSRQVTFSKRRNGLLKKAFELSVLCDAEVALIVFSPRGKLYEFASSSMQETIERYRRHVKENNTNKQPVEQNMLQLKEEAASMIKKIEHLEVSKRKLLGECLGSCTIEELQQIEQQLERSVSTIRARKNQVFKEQIELLKQKEKLLAAENARLSDECGAQSWPVSWEQRDDLPREEQRESSSISDVETELFIGPPETRTKRIPPRN

SEQ ID NO: 8674 - protein, 104 aa, Quercus suber
SLDIWDPFDGLFTSVRETSSFSNVRIDWKETPEAHVFKADLPGLKKEEVKVEVEEGRVLQISGERSKEQEEKNEKWHRVERSSGKFLRRFRLPQNAKIDEVKAS

SEQ ID NO: 8675 - protein, 245 aa, Unknown
  Afrostyrax sp. Cheek 5007
ALSIAGAVQSQKLAVRAISQLRSLPGGDIKLLCDTVVESVRELTGYDRVMVYKFHEDEHGEVVAESKRSDLEPYLGLHYPATDIPQASRFLFKQNRVRMIVDCNAMPVPVSQDEGLMQPLCLVGSTLRAPHDCHAQYMANMGSIASLAMAVIINGNDDEAIGGRNSMRLWGLVVCHHTSARCIPFPLRYACEFLMQAFGLQLNMELQLASQLLEKHVLRTQTLLCDMLLRDSPTGIVTQNPSTMD

SEQ ID NO: 8676 - protein, 110 aa, Quercus suber
SLDVWDPFEGFAQLSSHSNFPSETSSFAAAKVDWKETPNAHVFKADVPGLKKEEVKVEIEEGRVLQISGERSQEQEEKSDTWHRVERSSGRFSRRFRLPENAKVEEVKAA

SEQ ID NO: 8677 - protein, 245 aa, Unknown
  Afrostyrax sp. Cheek 5007
ALSIAGAVQSQKLAVRAISQLQSLPGGDIKLLCDTVVESVREHTGYDRVMVYKFHEDEHGEVVAESKRSDLEPYLGLHYPATDIPQASRFLFKQNRVRMIVDCNAMPVPVSQDEGLMQPLCLVGSTLRAPHDCHAQYMANMGSIASLAMAVIINGNDDEAIGGRNSMRLWGLVVCHHTSARCIPFPLRYACEFLMQAFGLQLNMESQLATQLVEKHVLRTQTLLCDMLLRDSPTGIVTQNPSTMD

SEQ ID NO: 8678 - protein, 297 aa, Zea mays
MDWGNRTKAAAAAAAPDERAGGGEGLGGYVKVMTDEQMEVLRKQISIYATICEQLVEMHRVLTEHQDTIAGGLLGSVCYLTMVITGLRFSNLYCDPLIIPGGHKITARQRWQPTPMQLQILESIFDQGNGTPSKQKIKEITAELSQHGQISETNVYNWFQNRRARSKRKQAAASLPNNAESEAEADEEPLADKKPKSDRPPPPPPPIQDNTKATGALSADRVSGGTRHLDTGHDQTSGVMYGCNDSGLLRSSGSSGQMSLYENFMSNPRIDRFPAKVESSRSFPHLQQHGEGFGMFG

SEQ ID NO: 8679 - protein, 838 aa, Bdellovibrio bacteriovorus
MGSASFLKNLLTRFGVEFGLMGLIGLGFLTFQRPELLKLSQYSERPSNEMTEVLRTTEQILVRAEAAQDRFLVSRQPTDLQSYNSEITALNGQLARMSQLVRNKPREHAMAVKLGHLIRAHIETANTQVMTPQRRPAQTEESLDKTRYQIRHQLIEMQAASAPAIKFKPTKEGQNFLLGLCAAIVLIIASRVLQRKEQHETRKAVEALQGKSILLDTILNSMSEALIVVDQNGWFTHYNAAAQRIIGSKIKEISTDSSVEQLGFFNQAEGRPFTRKELPLYRALSGDRVDDLEIFVQNSEHPEGIYISLSSRPLNDIDGGISGALIVFKDISRRKMVEQEWIRAREAALEASQKKSDFLAAMSHEIRTPMNGVIGMTTLLADTHLNPEQTDYVGNIKRSAESLLMLINDLLDHSKIEAGKIRLDPQPLDLQFLVEDVLEMFKPTVAEKNIGLECRFDGKNLWHYRADAGRLRQILVNLMGNAVKFTEKGFVRLEVSSRGDKDGKTALLFEVKDTGQGLQEHEKRSLFQKYFQAKAGMKFGGTGLGLSICKQLVDLMGGDIGVESVPGVGSNFWFMVNLEECAGEVQPQSSEVRFARIFSGHVLVAEDQIVNQRVAESYLTKLGLKVEIAGNGQIALEKARSKSYDLIFMDCQMPVLNGYEATKQLRLLENTLGRKTPVVALTAEGTSGERKSCYEAGMDDFLTKPLELHKLIETLHRWLKPSEKNLDLKALESLKDLVSHDRSLTEVLIEDLEQSGPVLLHEIREGIESRNLEKVSESAHALKSSAATLGAKQVSELCQKLEDLQDFTEAEFLLKQTERKFFESLSELKTYSSRVRAA

SEQ ID NO: 8680 - protein, 105 aa, Arabidopsis thaliana
MDPLLWDQLASHSTAFAVEQFSDGVGYSWIDGLKDHAAQNVNDKMMSNAGHIFPHNTPNTKEAYYYRMIFERFFPQNSARLTVPGGATVACSTAKAEDQLAFHST

SEQ ID NO: 8681 - protein, 250 aa, Triticum aestivum
SPTRAPASASPRTTPSSSRYARVELPRYRMPENSIPKETAYQMITDELMLDGNPRLDLASFVTTWMEPECNKLIMDSINKNYVDMDEYPVTTELQNRCVNMIAHLFNAPINEDEKAIGVSTVGSSEAIMLAGLAFKRKWANKRKEEGKPYDKPNIVTGANVQVCWEKFARYFEVELKEVKLTEGYYVMDPLKAVEMVDENTICVAAILGSTLTGEYEDVKLLNDLLVGKNKETGYAFYLLAVVSQFGKLP

SEQ ID NO: 8682 - protein, 158 aa, Triticum aestivum
  misc_feature (58)..(58): Xaa can be any naturally occurring amino acid
MSLIRRSNVFDPFSLDFFDPFEGFPFGSGNSGSGSLVPRTSSDTAAFAGARIDWKETXPEAHVFKADVPGLKKEEVKVEVEDGNILQISGERNKEQEEKTDTWHRVERSSGKFLRRFRLPENAKAEQVKASMENGVLTVTVPKVEAKKPEVKSIHISG

SEQ ID NO: 8683 - protein, 526 aa, Bdellovibrio bacteriovorus
MERVGRAEVLSSPRFFIISLMVLVLGASLYLVRLSGKDVSKVKSGEDYWAETGLGPAALEDLLQDQTCGSSERYFLACANAILTVANRYNLSLNLQGELVPVHEALSADMSSEKKQLEPWKEYFTSQTAKATQISFLKAWEQLKSEYIKPKQSSMMVGLGLNGFISVFRDPHTYFMPVNQFQEVISRADSRSVTLGITLGSHKGQYVVRKLTEGSPAKLSGIQKGDVLISINDTSVKGLMQPRVSELLKGEVGDVVRIRVERDGEAMKFRLRRQEITVATVSTRVIEGIKPIAVIGINKFARGACEKVKESLEIVKRSHVRGLLLDLRDNPGGQMEEAACIASLFVGPENKIFEVRYLDPSKKAEVFYGGEEKHFDMPMAVLVNAASASASEIVAGALRDLNRAVLVGERTFGKGSFQEGEYWSQNKKIALFETKGFYYLPSGRSPQMKGLEPDVAVNFEEISVVREAEQFINPLRAPERQVRAMAQSMSSSECLDLEDGSPSDDLQLTKARQVLFCTKAVARAGL

SEQ ID NO: 8684 - protein, 498 aa, Oryza sativa
KGLDCTVILSSLSNKKRWKKQLMEEFELQQQPYYSKLLLGSPLEIANVDDSDLQLVAGVPSDPPPAPPTAVKKKKKRSLPGTPDPSAEVVALSPRTLLATNRFVCEICGKGFQRDQNLQLHRRGHNLPWKLRQRGGAGGGGGGEPPRKRVYVCPEASCVHHSPSRALGDLTGIKKHFCRKHGEKKWKCDRCGKRYAVHSDWKAHSKVCGTREYKCDCGTVFSRRDSFVTHRAFCDALAQENNKLAQPMNMAAVTSALQGQQQAHHPVADDDDAAGVKSPHLKMFPDVDNIVAAATAGNPLLPPPLSMAGCMLSSLAAPLSSPFLPGCKLGVDAARDAAMVFPPPPPPAGSAAAIMSATALLQKAAELGATTSTGCYGGVAFPAMGIAGGLDRLPAIGHHLAPYDDVVVPAALQGQTATQLVGFDLGGLLPGQLYGGGGGAMTRAIGSLMHGGDQHAGVVDRRRGEGVRVVDYMGVDDDDDHGCFDGVGPFGPHIGPWA

SEQ ID NO: 8685 - protein, 251 aa, Wigglesworthia glossinidia
MNLVSISINEDNYIWLLYNNDKNCIIVDPGEFISIHNICKKKKLTPVAIFLTHHHHDHVDGVESLKTYFNTPVYGPKETIKYGTTKIVKEGDEIFLLNKCFKVFELPGHTLGHVGFYSPPWFFCGDTLFSAGCGRLFEGSAKDMYFSIKKINSLPPNTLICAGHEYTLQNLNFAISVFPKNTILSMYKKKVEKLNFYKKPTLPSALYLERQINIFLNPYNFEFKGELKRLLLQEEWVLFKKLRDMKNNFIY

SEQ ID NO: 8686 - protein, 260 aa, Listeria monocytogenes
MPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 8687 - protein, 471 aa, Legionella pneumophila
MTIALVWFRQDLRLTDNPAFIEACSHHEIVIPLYIYDDKCSVLGQAQAWWLHHSLIALGKSLNQQGLCLVLRKGAPQEIILELVAQYGVESVYWNRCYEPQAIARDKKIKLALGEREIKVQSFNGNLLHEPWTIKNKNGDFFKVFTPYWKQCRQILNIPSPFMLTKRPRGIKITSDDLGKWKLLPAINWAARFSEYWTPGEEGAQKKLDEFIVHHLSGYKRERDFPAKNATSRLSPHLHFGEISPWVILRALELAKLEQTCDLASVEHFLSELGWREFSVYLLYHFPKLDCENFRKEFDAFPWQNDEQLLTCWQKGMTGYPIIDAGMRELWATGYMHNRVRMIVASFLTKDLLIDWRSGAQWFLDTLVDADLANNSASWQWVAGCGADAAPYFRIFNPVLQSQKFDPDGVYIRQWIPELAQLNSQSIHQPWTDADASSIFLGKKYPKPIIDHQEARTKALSYYQQIKKGMD

SEQ ID NO: 8688 - protein, 81 aa, Oryza longistaminata
YVKFHWKPTCGVSCLMDDEATLVGGKNHSHATQDLYDSIAAGNFPEWKLFVQVIDPEEEERFDFDPLDDTKTWPEEEVPLR

SEQ ID NO: 8689 - protein, 90 aa, Oryza longistaminata
DAKARYVKFHWKPTCGVSCLMDDEATLVGGKNHSHATQDLYDSIAAGNFPEWKLFVQVIDPEEEERFDFDPLDDTKTWPEEEVPLRPVGR

SEQ ID NO: 8690 - protein, 90 aa, Vernonia galamensis
REQDRFMPIANVIRIMRKILPPHAKISDDAKETIQECVSEYISFVTGEANDRCQREQRKTITAEDVLWAMSKLGFDDYIEPLTVYLHRYR

SEQ ID NO: 8691 - protein, 115 aa, Zea mays
  misc_feature (55)..(55): Xaa can be any naturally occurring amino acid
HASSNTLDGLNGFDGTDTHYFHSGPRGHHWMWDSRLFNYGNWEVLRFLLSNARWXLEEYKFDGFRFDGVTSMMYTHHGLQVTFTGNFNEYFGFATDVDAGVYLMLVNDLIHGLYP

SEQ ID NO: 8692 - protein, 89 aa, Oryza longistaminata
DAKARYVKFHWKPTCGVSCLMDDEATLVGGKNHSHATQDLYDSIAAGNFPEWKLFVQVIDPEEEERFDFDPLDDTKTWPEEEVPLRPVG

SEQ ID NO: 8693 - protein, 90 aa, Argemone mexicana
  misc_feature (75)..(75): Xaa can be any naturally occurring amino acid
REQDRYMPIANVIRIMRKVLPTHAKISDDAKETIQECVSEYISFITSEANDRCQREQRKTITAEDVLWAMSKLGXDEYIEPLTLYLQRYR

SEQ ID NO: 8694 - protein, 115 aa, Zea mays
  misc_feature (100)..(100): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYNHHGLQVTFTGNFNEYFGFATDVDAXVYLMLVNDLIHGLYP

SEQ ID NO: 8695 - protein, 543 aa, Streptococcus pyogenes
MAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLGGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPAAPAPAMPAGMDPGMMGGF

SEQ ID NO: 8696 - protein, 558 aa, Leptospira interrogans
MNTSNNHSVPIPLNETARLRALHSYQILDTASEEKFDSLTQIAAYICNSSMALISLVDTNRLWFKSKLGMQESEAPRKISFCQYAIMKDDLLEIEDALENEIFKNKPSVLGPPYIRFYVGAPLKTPDGFNIGTLCVFDSQPKHLNPKQRVILKALSNQIIYNFELNKKNIELLLIQKKEEELQKSKSLFFANMSHEIRTPVHGILGVSGLLSETELQQEQKEYVDTIQRSGKLLLNLLNDILDFSKLESFNMKIEIIAFDLIDLLKDVFHLFEADAKRKNIEFKLVGKQPSHSIVSTDPHRFKQILVNLISNAIKFTEKGSVLIEFDFKSDLKHCDIQIRIKDTGVGIPEQKLKELFQAYRQVDTSVSRKYGGTGLGLSISKNLSEMMNLKLTARSIINQGSVFEISGQIPLAEKSEVNFEPKKATQNIEIQNLNILVAEDNETNQMLIKKILEKLGYKPVIVSNGIEALHHIKMYKTDVLFLDIQMPELNGIEAAKILTQQNDSSIRPYIIAMTANASQTDKEDCMASGIDQYLSKPFHKEEIADLLNQFISHKTTN

SEQ ID NO: 8697 - protein, 410 aa, Aspergillus nidulans
MPPGLPTTMTETRLFKPIKIGTVQVQHRIGMAPLTRLRANPDRTPTSLMKEYYTQRASVPGTLIITEGTLISTASAGAFPGAPGIWRADQVAAWKEITDAVHKRGSFIYVQLFSMGRAAEKKLAESEGIEVVAPSAIPIPYDEKPDAPIPRAMSVAEIQQTIVDFVKASKDALTAGFDGVEIHGANGYLLDQFLQDTSNQRDDEYGGSVANRSRLLHQVLQKVAKAIGADKVGLRLSPWSRFQGMRMDDPIPQFADIIDKASDLNLAYLSLIEARVFGARDYEGSLDGDKETLDFVYERWHGPVLVAGGYELEKARRLVDEQYPKKDIVVLFGRHFISNPDLVYRFKEGVELTKYQRETFYEIRSAVGYVDYPFSKEYSATINLAGSRVGRLSDLRKCGSPGLDFSSSKS

SEQ ID NO: 8698 - protein, 115 aa, Zea mays
  misc_feature (100)..(100): Xaa can be any naturally occurring amino acid
HASSNTLDGLNGFDGTDTHYFHSGPRGHHWMWDSRLFNYGNWEVLRFLLSNARWGLEEYKFDGFRFDGVTSMMYTHHGLQVTFTGNFNEYFGFATDVDAXVYLMLVNDLIHGLYP

SEQ ID NO: 8699 - protein, 245 aa, Reinwardtia trigyna
ALSIAGAVQSQKLAIRAISQLQSLPGGDIKLLCNTVVDCVRELTGYDRVMVFKFHEDEHGEVVAENKRADLEPYLGLHYPATDVPQASRFLFKQNRVRMIVDCHASAVRVVQDEGLVQPLCLVGSTLRAPHGCHAQYMANMGSIASLAMAVVITGNDEEGTGGRNSTRLWGLVVCHHTSARCIPFPLRYACEFLMQAFGLQMNVELQLASQLLEKHVMRTQTLLCDMLLRDSPTGIVTQSPSIMD

SEQ ID NO: 8700 - protein, 365 aa, Averrhoa carambola
ALSIAGAVQSQKLAVRAISQLQLLPGGDIKLLCDTVVESVRELTGYDRVMVYKFHEDEHGEVVAESKRPDLEPYIGLHYPATDIPQASRFLFKQNRVRMIVDCNAKPVRVIQDEGLMQPLCLVGSTLRAPHGCHAQYMANMGSIASLAMAVIINGNDEEAIGGRNSMRLWGLVVCHHTSARCIPFPLRYACEFLMQAFGLQLNMELQLASQLSEKHVLRTQTLLCDMLLRDSPTGIVTQSPSIMDLVKCDGAALYYQGKYYRLGVTPTEAQIKDIIEWLLAFHGDSTGLSTDSLADAGYPGATSLGDAVCGMAVAYITKTDYLFWFRSHTAKEIKWGGAKHHPEDKDDGQRMHPRSSFKAFLEVV

SEQ ID NO: 8701 - protein, 365 aa, Averrhoa carambola
ALSIAGAVQSQKLAVRAISQLQLLPGGDIKLLCDTVVESVRELTGYDRVMVYKFHEDEHGEVVAESKRPDLEPYIGLHYPATDIPQASRFLFKQNRVRMIVDCNAKPVRVIQDEGLMQPLCLVGSTLRVPHGCHAQYMANMGSIASLAMAVIINGNDEEAIGGRNSMRLWGLVVCHHTSARCIPFPLRYACEFLMQAFGLQLNMELQLASQLSEKHVLRTQTLLCDMLLRDSPTGIVTQSPSIMALVKCDGAALYYQGKYYRLGVTPTEAQIKDIIEWLLAFHGDSTGLSTDSLADAGYPGATSLGDAVCGMAVAYITKTDYLFWFRSHTAKEIKWGGAKHHPEDKDDGQRMHPRSSFKAFLEVV

SEQ ID NO: 8702 - protein, 262 aa, Nitrosomonas europaea
MINVFPVRAFRDNYIWIVHNQQFALIIDPGDATPVLTWLRQQKLQPIAILCTHHHHDHTGGISLLVQKFEIPVYGPASEKIPGMTHPLAEGDTLVFPELSLELSILDVPGHTAGHIACHGQNRLFCGDTLFACGCGRIFEGNAQQMFDSLQKLTDLPDETQVYCAHEYTLDNIRFARAIDPDNPELIELESNVEEKREQNMPTLPSSLAAEKATNPFLRCNQPAIIQSASRYAGRQLTDPVSVFAAIRDWKNNFRGNTDLPM

SEQ ID NO: 8703 - protein, 360 aa, Acanthothamnus aphyllus
AVQSQKLAVRAISHLQSLPGGDIKLLCATVVDSVRDLTGYDRVMVYKFHEDEHGEVVAESKRPDLEPYIGLHYPATDIPQASRFLFKQNRVRMIVDCRASPVGVRQDDGLMQPLCLVGSTLRAPHGCHAQYMENMGSKASLAMAVIINGNDEESIGGRNATRLWGLVVCHHTSARCIPFPLRYACEFLMQAFGLQLNMELQLAAQLSEKHVLKTQTLLCDMLLRDSPTSIVTQSPSIMDLVKCDGAALYYQGKYYPLGVTPAEAQIKDIVEWLLAFHGDSTGLSTDSLGDAGYPGAALLGNAVCGMAVAYITNRDFLLWFRSHTTKEIKWGGAKHHPEDKDDGQRMHPRSSFKAFLEVVK

SEQ ID NO: 8704 - protein, 727 aa, Xylella fastidiosa
MRLRILNSLKVALLTLAITTAPALMAKSDSASPQVATPDQTTATKLVYGLLSDSRYAYRLRPLDEAMSKDIFKRYLEALDSNKQFFTEADIDNFSAFKAEIPDSIRNGNLKPAFSIFAVYKKRVAERVTYANQLLKQNFDFSGQEKYEYDRSKAPWPASPQDLDDIWRRSTMNDWLRLKLAGKKPEDIRKTLKKRYANLLKTVNELKGEDVFQLYLNAYTNSIDPHTDYFTPRTADAFNQQMSLSLEGIGAQLQKQEDMVIIREVIPGGPTALDGTLKPGDRIVGVGQGKGGPIEDVIGLRIDDVVSKIRGKKDTQVRLEYIPAESGIDGAHRIVTLTRQKVRLAEQAAKGETITIEGSNGDAQRRIGIIKLPTFYEDFEGRRRNVANYTSATRDVAKLLTNFKTDKVDGVVLDLRNNGGGSLDEAIQLTGLFIEQGPVVQVRESGGRVTVNGDRDDKVTWDGPLAVLINRGSASASEIFAGAIQDYGRGLVIGETSFGKGTVQNIVDLDRWPANESRRFGQVKLTIAQFFRISGSSTQHKGVLPDIAFPASVGATEFGESTYENALPWTRIASLQHTQYGNFSPILSKLKKIHISRTANDIEFKWWQEDVHNFSLEKEKKYVILNEAERLAERRKQETQHRERQTIRKNLGLQLDPLSEESDDGLIGNERDIAKDTAREKLADKRPDPLLHESAAILTDTINLLEKDQILSAQVLLQSTTPGHWAN

SEQ ID NO: 8705 - protein, 316 aa, Brassica oleracea
MAEKPAPEQEQEQTRAMEPAVLDDIIRRLVEFRNTRPGSGKQVHLSEGEIRQLCAVSKDIFLQQPILLELEAPIKICGDIHGQYSDLLRLFEYGGFPPDANYLFLGDYVDRGKQSLETICFLLAYKIKYPENFFLLRGNHECASINRIYGFYDECKRRFNVRLWKIFTDCFNCLPVAALIDRILCMHGGISPELMSLDQIRSISRPLDIPDSGLVCDLLWSDPSGDVKGWGANDRGVSYTFGADTVAEFLQKNDMDLICRAHQVVEDGYEFFAERQVVTVFSAPNYCGEFDNAGAMMSIDESLMCSFQILKPSEKK

SEQ ID NO: 8706 - protein, 727 aa, Unknown
  Parachlamydia sp. UWE25
MMTMQQTEFDSQFNEHIYRIVHVVHHQPHAFLGLHSFFEGSKVIRLWRPNAQQIFLELFGNIVEARRIHEMGIFECIVPSHTTAIDYKIFHQNGKLHFDPYAFLPTFGEVDQYLFGKGVHYELYHQMGGRLATHQGIQGVKFAVWAPNAKSVSLIADFNHWDGKVNPMRIMGYSGVWELFVPGLQEGEKYKFEIHTQQGERILKSDPYALSSELRPATASKIANIERFQWQDQAWMEQRKAKNWTSLPMNIYEVHLGSWKKKDSNSEFLNYRELAHELTAYCLDMGFTHIELLPIQEHPLDESWGYQVSGFYAPTSRFGHPEDFQYFVNYLHQHQISLILDWVPGHFPTDAFSLARFDGSALYEHADPRQGYHPHWHTNIFNFGRHEVSNFLIANALYWLEIMHVDGLRVDAVASMLYLDYGREENEWIPNDVGGKENLQAIEFLKHLNSIVHSKCPGSLMIAEESTSFTGVTHSVEKGGLGFDLKWNMGWMNDTLRYFSKDMLFRNYHHHDLTFGLVYAFSEKFISVFSHDEVVHGKKSLLSKMPGDMWQQFANLRLLISYMICQPGKKLLFMGAEIGQWNEWNCKSGLEWFLLQFPTHAGIHKFVQEINHFYLKQPALWQKDFSHESFEWVDFADMHNSVISYVRKGGTERLLCVHNFTPLYHSDYILHLSQFEHIEEIFNSDAEKFGGSGKHNLNPEIIRNEARSVIGLRLILAPLATLIFKLS

SEQ ID NO: 8707 - protein, 713 aa, Agrobacterium tumefaciens
MARKPNSTSSITATIHDQQLIRGAGGELHQIATGDEPVLTTAQGAPVADDQNSLRIGPRGPLVVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKLGKASVPVNKE

SEQ ID NO: 8708 - protein, 492 aa, Cucurbita pepo
MDPYRHRPSSAFNAPFWTTNSGAPVWNNNSSMTVGPRGPILLEDYHLVEKLANFDRERIPERVVHARGASAKGFFEVTHDITNLSCADFLRAPGVQTPVIVRFSTVIHERGSPETLRDPRGFAVKFYTREGNFDLVGNNFPVFFIRDGMKFTRHVHPLKPNPKSHIQENWRILDFFSHHPESLNMFSFLFDDIGIPQDYRHMDGSGVNTYTLINKAGKAHYVKFHWRPTCGVKSLLEEDAIRVGGSNHSHATQDLYDSIAAGNYPEWKLFIQTIDPDHEDKYDFDPLDVTKTWPEDILPLQPVGRMVLNKNIDNFFAENEQLAFCPAIIVPGVYYSDDKLLQTRIFSYADTQRHRLGPNYLQLPANAPKCAHHNNHHEGFMNFMHRDEEVNYFPSRFDPSRHAERYPHPPAVCSGKRERCIIEKENNFKEPGERYRSWTPDRQERFVRRWVDALSDTRVTHEIRSIWISYWSQADRSLGQKLASHLNVRPSI

SEQ ID NO: 8709 - protein, 89 aa, Oryza longistaminata
DAKARYVKFHWKPTCGVSCLMDDEATLVGGKNHSHATQDLYDSIAAGNFPEWKLFVQVIDPEEEERFDFDPLDDTKTWPEDEVPLRPVG

SEQ ID NO: 8710 - protein, 856 aa, Vigna radiata
MVYTISGIRFPVVPSLNVSSLRGDRRAASLPVFLRKNDFSRKILAVKSSHDSDSPSSAIAESDKVLIPQDQDNSASLTDQLETPVITSEDAHNLEDLTMEDEDKYSISEADTSYRQIEGELGSVVSVGKKVNIPSDEAKPKTIPRPGAGQKIYEIDPSLLAHREHLDFRFGQYKRLHDEINKYEGGLDTFSRGYEKFGFIRSATGVTYREWAPGAKSAALIGDFNNWNSNADVMTRNEFGVWEIFLPNNVDGSPPIPHGSRVKIRMDTPSGVKDSIPAWIKFSVQAPGEIPYSGIYYDPPEEEKYVFKHPQPKRPKSLRIYESHVGMSSPEPMINTYANFRDDVLPRIKKLGYNAVQIMAIQEHSYYASFGYHVTNFFAPSSRFGTPEELKSLIDKAHELGLLVLMDIVHSHASNNTLDGLNMFDGTDSHYFHPGSRGYHWMWDSRLFNYGSWEVLRYLLSNARWWLDEYKFDGFRFDGVTSMMYTHHGLQVAFTGNYSEYFGMATDVDAVVYLMLANDLIHGLFPEAVTIGEDVSGMPTFCLPTQDGGVGFDYRLQMAIADKWIEILKKQDEDWKMGDIVHTLTNRRWLEKCVAYAESHDQALVGDKTIAFWLMDKDMYDFMALDRPSTPRIDRGIALHKMIRLITMGLGGEGYLNFMGNEFGHPEWIDFPRGEQQLPNGSVIPGNNYSYDKCRRRFDLGDADYLRYRGMQEFDRAMQLLEEKFGFMTAEHQYISRKNEGDKVIIFERGNLVFVFNFHWHNSYSDYRVGCSTPGKYKIVLDSDDALFGGFNRLNHSAEYFTNEGWYDDRPRSFLVYAPSRTAAVYALADDDLEPALSDEAEPVLADEAEPEPVDP

SEQ ID NO: 8711 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFGVKFYNRGGNFDLVGNNVPVFFNRDAKSFPDTIRALKPNPKSHIQEDWRTLDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYFPSRFDPCRPAEQYPIPACVLNGRRTNCVIPKENNSKQAGERYRSWESDRQDRYINKWVESLSDPRVTHEIRSIWISYLSQADKSCGQKVASRLTVKPTM

SEQ ID NO: 8712 - protein, 492 aa, Triticum aestivum
MDPYKYRPSSSFNAPMWSTNSGAPVWNNDNSLTVGSRGPILLEDYHLVEKIADFDRERIPERVVHARGASAKGFFEVTHDVSHLTCADFLRAPGVQTPVIVRFSTVIHERGSPETLRDPRGFAIKFYTREGNWDLVGNNFPVFFIRDGMKFPDMVHALKPNPKTHIQENWRILDFFSHHPESLHMFTFLFDDIGVPADYRHMDGSGVNTYTLVNRAGKAHYVKFHWKPTCGVKSLLEEEAVTVGGTNHSHATKDLTDSIAAGNYPEWTFYIQTIDPDHEDRFDFDPLDVTKTWPEDVVPLQPVGRLVLNRNIDNFFAENEQLAFCPGIIVPGVYYSDDKLLQTRIFSYSDTQRHRLGPNYLLLPANAPKCSHHNNHYDGLMNFMHRDEEVDYFPSRFDPAKHAPRYPIPSRTLNGRREKMVIEKENNFKQPGERYRSMDPARQERFINRWIDALSDPRLTHEIKAIWLSYWSQADKSLGQKLASRLSSKPSM

SEQ ID NO: 8713 - protein, 492 aa, Cucurbita pepo
MDPYKYRPSSAYNTPFCTTNSGAPIWNNTAVMSVGERGPILLEDYQLIEKIATFTRERIPERVVHARGASAKGFFEVTHDVSDLSCADFLRAPGVQTPVIVRFSTVIHERVSPETVRDPRGFAVKFYTREGNFDLVGNNFPVFFVRDAMQFPDVIRAFKPNPKSHLQESWRFLDFCSYHPESLLSFAWFYDDVGIPINYRHMEGFGVQAYSLINKAGKARLVKFHWKPTCGVKSMLEEEAIRVGGSNHSHATQDLYESIAAGNFPEWRLYIQTIDYEDQNNYDFEPLDTTIAWPEDVVPLRPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDACRHAEKYPMPPNVLSGKRERCVIPKENHNFKQAGDRYRSWAPDRQERFVNRFVEALSDSKVTHEVRNIWISYWTQADRSLGQKIASRMNARPNM

SEQ ID NO: 8714 - protein, 735 aa, Vigna radiata
MFNCLCLNPFISVSSTVACTSHTVRSRQRLAPQKSVDLALGYRNPLGYGFGFGLRRSLHEMVSSRFKGVAVMTDDKSTISSTEEYLENIGIFSIDPSLKPYKDHFKYRLKRYVDQKKLIEEYEGGLEEFAKGYLKFGFNREEGGIVYREWAPAAQEAQIIGDFNGWDGSNHQMEKNQFGVWSIKIPDADGNPAIPHSSRVKFRFRHGDGVWVDRIPAWIKYATVDPNRFAAPYDGVYWDPPLSERYEFKYPRPPKPKAPRIYEAHVGMSSSEPRINSYREFADEILPRIRANNYNTVQLMAVMEHSYYASFGYHVTNFFAVSSRSGTPEDLKYLIDKAHSLGLQVLMDVIHSHASNNITDGLNGFDVGQTSQDSYFHAGDRGYHKLWDSRLFNYANWEVLRFLLSNLRWWLEEFKFDGFRFDGVTSMLYHHHGINIAFTGDYNEYFSEATDVDAVVYLMLANSLIHSILPDATVIAEDVSGMPGIGQQVSDGGIGFDYRLAMAIPDKWIDYLKNKNEYTWSMKEISWSLTNRRYTEKCVSYAESHDQAIVGDKTVAFLLMDEEMYSGMSCLVDPSPIVERGIALQKMIHFITMALGGEGYLNFMGNEFGHPEWIDFPREGNGWSYEKCRRQWNLVDTDHLRYKFMNAFDRAMNLLDDKFSFLASSKQIVSSADDEDKVIVFERGDLIFVFNFHPENTYEGYKVGCDLPGKYRVALDSDAWEFGGHGRVRSPNLWG

SEQ ID NO: 8715 - protein, 91 aa, Oryza longistaminata
RDAKARYVKFHWKPTCGVSCLMDDEATLVGGKNHSHATQDLYDSIAAGNFPEWKLFVQVIDPEEEERFDFDPLDDTKTWPEEEVPLRPVGR

SEQ ID NO: 8716 - protein, 352 aa, Methanopyrus kandleri
MSLIEIDGSYGEGGGQILRTAVGMSALTGEPVRIYNIRANRPRPGLSHQHLHAVKAVAEICDAECEGLEIGSTEIVFEPGKVKGGEYEVDIGTAGSVTLLLQAVKLAAIAADGPVEMEVRGGTDVKWSPPVDYEINVNAHYLDRLGYRYELEVLRRGHYPRGGGIVRARMEPPKRLKPLEAVKFGELESVRGISHCVRLPPHVAERQAKAASEIIERELGIRPEIEIETYPKGRDPHLGPGSGIVLWAEDDQGNRIGADALGEKGKPAEVVGREAAEQLVQRLRTGMALDEHMGDQILPFLAIADGESVFGVTGVDPHLPTNAWVVEKFLPVSVEIRGKEGEPATVEVRPEG

SEQ ID NO: 8717 - protein, 90 aa, Oryza longistaminata
RDAKARYVKFHWKPTCGVSCLMDDEATLVGGKNHSHATQDLYDSIAAGNFPEWKLFVQVIDPEEEERFDFDPLDDTKTWPEEEVPLRPVG

SEQ ID NO: 8718 - protein, 115 aa, Zea mays
  misc_feature (55)..(55): Xaa can be any naturally occurring amino acid
  misc_feature (100)..(100): Xaa can be any naturally occurring amino acid
HASSNTLDGLNGFDGTDTHYFHSGPRGHHWMWDSRLFNYGNWEVLRFLLSNARWXLEEYKFDGFRFDGVTSMMYTHHGLQVTFTGNFNEYFGFATDVDAXVYLMLVNDLIHGLYP

SEQ ID NO: 8719 - protein, 485 aa, Candida albicans
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLTNEEAGALAGSNPDYAQEDLFKNIAAGNYPSWTAYIQTMTEAEAKEAEFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 8720 - protein, 392 aa, Candida albicans
MTISNSNLFKPIKVGNKTIKNRIAHLPTTRNRATDDHVPTDLMKKYYTDRAKSGSLLITEATLISLDQGVYPNVPGMWNKQQKDAWKEITDSVHSIGGTIAIQLWALGRVGNAKLLKDEGLPLTGVSPIYEHEKAEQDAIDAGNPIQELTQDQIKDIVYNQFANAVKLADEAGFDFIELHGANSYLFEQFIHPGTNKRTDKYGGSIENRARFLFEVVDHVSTIVDPAKLAIRLSPLNNFQVPFVNPEGQEDYSYIVEGLQKRADEGKGLAFIDVVEGRFTSDGGTEGCNVDFVGEIWKGPLLKGGNYTYDRKNEWKTIENDANADDRTLVGFGRYFIANPDLPARIQKGNELNDYDRSTFYNTDDYGYNTYPFYGEENKADPNIKVLGVALA

SEQ ID NO: 8721 - protein, 115 aa, Zea mays
  misc_feature (100)..(100): Xaa can be any naturally occurring amino acid
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAXVYLMLVNDLIHGLYP

SEQ ID NO: 8722 - protein, 910 aa, Desulfotalea psychrophila
MSLRNFFLALFFAVLFFFSSAIAFAGWQEAPVVLILNSYHQGFGWGDAEVEAEIDVLRENFPEMSLYIEHMDQKRFPGEEGERHTLQQLEFKFAKFSPDIIIANDNIAFAFALRLRDLLWSDIPIVFSGYNGDDRLLDSLGSGVTGVFEEIDAVGTINMALKLQPGIKHVFVVVEDTITGRAVLTNVQPKLRQFGDRLRFEYLAEKGLPEILARLRLASDESIVLLLPYATSQPGTHMDARSLADLIIETSPVPVYTPYDFHLGLGALGGYVLEGKEQGQLAAELAVKILTTGNIPAPVKEELHFSPVFDNEVLNRFSIEVSELPPGSEVINQLSLGFYEQNTTFINLIALIAILLVSLLLTLLINIHLQRNAERKFVEIFDATSEAVLVCDIDTLQVLEFNRSSELLLGAEEQLVKLTDLRWNFCGEEPYDDQAFQQLIERTVRDGSLTVDWQMKRYSGEKFWAGMTLNYMQIKDVDCLLVVIRDVEQRHQLAGELEAYKFHLEELVDQKTADLQRFQQDLITAKDEAERANQAKSTFVANMSHEIRTPLNGVLGLAQLLEKTSLSVDQRSYVRRILDSGQQLLTTVNDILDFAKMEAGRLEIEESGFSLHALLQPVIDSVFVEEESSPKFCLDVAPGIPENLIGDRFRIGQVLINLLGNALKFTKEGHVSLHVVSMGLGEKGVILKFSIIDTGVGIALDVQKQLFVPFTQADSSVTRNYGGTGLGLTICKKLVVAMGGDIGLESSPGAGSTFWFTLDLGVGQEGDAQNTEAVQVNSVDRKSLLEGLKILLVDDNEINLYMMEAILLAAGAEVTLAENGQECLERLEESSYDLILMDVQMPVLDGYETTRRIRKDEKYRALPIIAITANALSDDIEKCFEAGMNDHVAKPFKIEELDASIAKCLLASRS

SEQ ID NO: 8723 - protein, 374 aa, Acanthothamnus aphyllus
ALSIAGAVQSQKLAVRAISHLQSLPGGDIKLLCATVVDSVRDLTGYDRVMVYKFHEDEHGEVVAESKRPDLEPYIGLHYPATDIPQASRFLFKQNRVRMIVDCRASPVGVRQDDGLMQPLCLVGSTLRAPHGCHAQYMENMGSKASLAMAVIINGNDEESIGGRNATRLWGLVVCHHTSARCIPFPLRYACEFLMQAFGLQLNMELQLAAQLSEKHVLKTQTLLCDMLLRDSPTSIVTQSPSIMDLVKCDGAALYYQGKYCPLGVTPAEAQIKDIVEWLLAFHGDSTGLSTDSLGDAGYPGAALLGNAVCGMAVAYITNRDFLLWFRSHTTKEIKRGGAKHHPEDKDDGQRMHPRSSFKAFLEVVKSRSLPWEN

SEQ ID NO: 8724 - protein, 631 aa, Bordetella bronchiseptica
MIHLDGAAVDPAVLQGMTDAIAHRGPDGEGHWIDGNVGLGHRRLAIIDLSPAGHQPMISADSRYVLSYNGEIYNFRELRAELQGEGCQFRSQTDSEVLLHALIVWGVERTLSRLNGMFAFAWWDTRERKLLLARDRYGVKPLYFSMQGTTLAFGSEQKAILASAAFRRNLNKAALLEYFTFQNIFTDQTLLEDVHLLPAGHYAYLDCAKERPQLRLTQYWDFNFHEPAVPGTDTEYREELSRLFRQAVQRQLVSDVELGSYLSGGMDSGSITAVAAASHPYIKTFTCGFDLNSASGIELAFDERSKAEYMSYFFKTEHYEMVLKSGDMERVLPALAWHLEEPRVGQSYPNYYAAKLASKFVRVVLSGAGGDELFGGYPWRYYRAVVNNDFEHYVDKYYLFWQRLIPNSTLKQVFRPVWSDVSHVWTRNIFRDVFNSHADQLYSPEDYINHSLYFEAKTFMHGLLVVEDKLSMAHGLESRVPFLDNDLVDFATRCPVRLKLNNLADVIKLNENEPGHKTNKYFEKTRDGKQILRDVMRDYIPSDIAQAEKQGFSAPDASWFKGESMDFVKRTLFSKHARIYEIMDADTVRSLVAEHLSGERNRRLLIWSLLNVESWLAQYLDHGGVAGKGLA

SEQ ID NO: 8725 - protein, 115 aa, Zea mays
HASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYP

SEQ ID NO: 8726 - protein, 364 aa, Brexia madagascariensis
VQSQKLAVRAISRLQSLPGGDIKLLCDTVVESVRDLTGYDRVMVYKFHEDEHGEVVAESQRPDLEPYIGLHYPATDIPQASRFLFKQNRVRIIVDCHASSVRVIQDDGLMQPLCLVGSTLRAPHGCHAQYMENMGSIASLAMAVIINGNDEEVIGGRNPTRLWGLVVCHHTSARCILFPLRYACEFLMQAFGLQLNMELQLAAQLLEKHVLKTQTLLCDMLLRESPTGIVTQSPSIMDLVKCDGAALYYQGNFYPLGVTPTEAQIKDIVEWLLAFHGDSTGLSTDSFADAGYPGAALLGDAVCGMAVAYITNRDFLFWFRSHTAKEIKWGGAKHHPEDKDDGQRMHPRSSFKAFLEVVKRRSLP

SEQ ID NO: 8727 - protein, 303 aa, Gibberella zeae
MADQHEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLMAAKTRQSIPSPR

SEQ ID NO: 8728 - protein, 462 aa, Listeria monocytogenes
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPSLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 8729 - protein, 249 aa, Unknown
  Fragaria x ananassa
MAYENKPNTDLDADAQRRLGRGKIEIKRIENTTNRQVTFCKRRNGLLKKAYELSVLCDAEVALIVFSNRGRLYEYSNNSSVRETIERYKKACADTSTNGSASEATTQYYQQEAAKLHNQINALQNINRGYMAEGLSNKNIKELKGMERKLERAITRIRSKKNELLFAEIEYMQKRELDLHNNNQLLRAKIAENERQQQSIIAITGGHGSYEIVQPTQPFHEARNYFQVNALQPNIHQYSCHDQVSLQLV

SEQ ID NO: 8730 - protein, 361 aa, Brexia madagascariensis
QSQKLAVRAISRLQSLPGGDIKLLCDTVVESVRDLTGYDRVMVYKFHEDEHGEVVAESQRPDLEPYIGLHYPATDIPQASRFLFKQNRVRIIVDCHASSVRVIQDDGLMQPLCLVGSTLRAPHGCHAQYMENMGSIASLAMAVIINGNDEEVIGGRNPTRLWGLVVCHHTSARCILFPLRYACEFLMQAFGLQLNMELQLAAQLLEKHVLKTQTLLCDMLLRESPTGIVTQSPSIMDLVKCDGAALYYQGNFYPLGVTPTEAQIKDIVEWLLAFHGDSTGLSTDSFADAGYPGAALLGDAVCGMAVAYITNRDFLFWFRSHTAKEIKWGGAKHHPEDKDDGQRMHPRSSFKAFLEVVKRRS

SEQ ID NO: 8731 - protein, 496 aa, Triticum aestivum
  misc_feature (266)..(266): Xaa can be any naturally occurring amino acid
HEVDKDFLFGASTSAYQIEGAWNEDGKGPSTWDHFCHTYPERISDRTNGDVAANSYHLYEEDVKALKDMGMKVYRFSISWSRILPNGTGKPNQKGIDYYNNLINSLIHHGIVPYVTIWHWDTPQALEDKYGGFLNRQIVNDYKHFAKVCFESFGDRVKNWFTFNEPHTYCCFSYGEGIHAPGRCSPGMDCAVPEGDSLREPYTAGHHILLAHAEAVELFKAHYNEHGDSKIGMAFDVMGYEPYQDSFLDDQARERSIDYNLGWFLXEPVVRGDYPFSMRSLIGDRLPMFTKEEQEKLASSCDIMGLNYYTSRFSKHVDISSDFTPKLNTDDAYASSETKGSDGNDIGPITGTYWIYMYPKGLTDLLLIMKEKYGNPPIFITENGIADVDSDPTMTDPLDDWKRLDYLQRHISAVKDAIDQGADVRGHFTWGLIDNFEWSLGYSSRFGLVYIDKKDGNKRKLKKSAKWFAKFNSVPKALLKTTNTNNKPAVTASVSL

SEQ ID NO: 8732 - protein, 112 aa, Beta vulgaris
HVIKIKDIILPPEREKFNDVYIVYELMDTDLHQIIRSNQELTEDHCQYFLYQLLRGLKYIHSANVLHRDLKPSNLLLNANCDLKICDFGLARTTAETDFMTEYVVTSWYAPG

SEQ ID NO: 8733 - protein, 363 aa, Campylostemon angolense
QSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGIGGRNPTRLWGLVVCHHTSVRCIPFPLRYACEFLMQAFGLQLNMELQLAAQLLEKHVLKTQTLLCDMLLRESPTGIVTQSPSIMDLVKCDGAALYYQGNYYPSGVTPTEAQIKDIVNWLLAFHGDSTGLSTDSLADAGYPGATLLGDAVCGMAVAYITNRDFLFWFRSHTAKEIKWGGAKHHPEDKDDGQRMHPRSSFKAFLEVVKSRSLP

SEQ ID NO: 8734 - protein, 657 aa, Oryza sativa
  misc_feature (313)..(313): Xaa can be any naturally occurring amino acid
  misc_feature (566)..(566): Xaa can be any naturally occurring amino acid
MSSRQPSESREGRRASGAGGASSSRSSSRVASRSGSVHRSKEKKPVCIGQYIIQQTLGAGSFGKVKLATHALTGHRVAMKIINRRKISSLDMGGRVKREIQYLKLLRHPHIIKLYEVITTPNDIIMVIEYAGGELFQYIVDRGRMPEPEARRFFQQVICAMEYCHRHKIVHRDLKPENLLLDEYLNVKIGDFGLSNIMTDGDFLKTSCGSPNYAAPEVISGRLYAGPEIDIWSCGVILYVMLCGRLPFDDEYIPTLFKKINNGIYTLPSYLSQEARHLLSQMLIVDPVKRITIHEIRQHPWFNVDLPAYLRPXAAHTGGGEPRLQLWPYRPAVLDDLGPIDAEIVDELVGKMVGFNRDELLHHLADKSDNQVKVAYQLVRDHRRMLQIHHMEDAHGMENFLAQSPPAWNEGLEGFMGRSTSIKRKNRDKEVAGGAAVRSTTREPLTDAEDAAGERMERIAVLETSLPGYLRAREAERLATPSADKTAWPQCTPLSPTSGSGTPALPAAAAAAAASAAAQIHKKPRSRWHFGIRSRSPPMEIMLELYRTLQSLGMEWRQKPVARAAXRRRTRARARARAMQPTKTNTRRAKARRQQARAWSCFSSRRAGRWGMWWCAWICSCTTWMRSTTSSTFATSATRCSSPRWEQGQARRMRVRR

SEQ ID NO: 8735 - protein, 361 aa, Campylostemon angolense
QKLAVRAISQLQSLPGGDIKLLCDAAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGIGGRNPTRLWGLVVCHHTSVRCIPFPLRYACEFLMQAFGLQLNMELQLAAQLLEKHVLKTQTLLCDMLLRESPTGIVTQSPSIMDLVKCDGAALYYQGNYYPSGVTPTEAQIKDIVNWLLAFHGDSTGLSTDSLADAGYPGATLLGDAVCGMAVAYITNRDFLFWFRSHTAKEIKWGGAKHHPEDKDDGQRMHPRSSFKAFLEVVKSRSLP

SEQ ID NO: 8736 - protein, 179 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISNV

SEQ ID NO: 8737 - protein, 492 aa, Cucurbita pepo
MDPYKYRPSSAYNTPFCTTNSGAPIWNNTAVMSVGERGPILLEDYQLIEKIATFTRERIPERVVHRRGASAKGFFEVTHDISNLTCADFLRAPGVQTPVIVRFSTVIHERGSPETLRDPRGFAVKFYTREGNFDLVGNNFPVFFVRDAMQFPDVIRAFKPNPKSHLQEPWRYLDFCSYHPESLLSFAWFYDDVGIPINYRHMEGFGVQAYSLINKSGKARLVKFHWKPTCGVKSMMEEEAIRIGGTNHSHATQDLYESIAAGNFPEWRLYIQTIDYEDQNKYDFEPLDTTITWPEDVVPLQPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDPCRHAEKFPMPPNVLTGKRERCVIPKENNNFKQAGDRYRSWAPDRQDRFVKRFVEALSDPRVTDEVRNIWISYWSQADRSLGQKIASRLNVRPNI

SEQ ID NO: 8738 - protein, 905 aa, Azotobacter vinelandii
MLTLLPSCLLALVLGIYFTWQQLAEMHGNLVGRGQLIVSQLAPLAAPALAQNYHNRLQRIANRVLDQTDIRAVSFLDSELGTIVHAGPSLNGPLPPQDPTQLTMVRDNSATHLLMPVLGYHQNLASGSNDRDDHLLGWIALEISHHNALLQGYRNLLASLLLILSVLLVSAFLALRVGRSISDPLRRIQQGVSQLRDGHLETRLPSLRSHELDELAAGINRMAEVMQHAQEEMQNSIDQATEDVRQNLETIEIQNIELDMVRREALEASRIKSEFLANMSHEIRTPLNGIIGFTNLLQKCELTPRQHDYLNTIQKSADSLLDIINEILDFSKIEAGKLVLEHTPFNLRELIQDTLTILAPAAHAKHLELVSLIYRDTPLALNGDPQRLRQVLTNLISNAIKFTNEGTIAVRAMVEDIGEEFAQLRISVHDTGIGLSQEDLNALFQAFSQADNSLTRQAGGTGLGLVISKRLIEQMGGEIGVNSVPGEGSEFWIRLSLPLDDHSEDEPPTALHGHRVALLEQHELARQSIQHQLEDCGLEVQPFAELDSLLAGVAAARQEERPVGLAVLGVTSRDTSAEELAQRIADLERLGCKCLVLCPTTEQMFYQEVLPEAQIQLQSKPAHRDKLQAALGELLTPQPTGSQTLGPLGNRAPRLLCVDDNPANLLLVQTLLGDMGAAVTVADSGHAAVEAAQRERFDLIFMDVQMPGMDGRQATRAIRQWEAGQPEQRHTPIIALTAHALANERRALLQSGMDDYMTKPINERQLAQVVHKWTRLHLRSPGAQQVHEVQPASIGHLSVLDSEEGLRLAAGKPDLAADMLSMLLASLDADRQAIHQARRDGDRAALIERVHRLHGATRYCGVPQLRAACQHSETLLKQHAPAADTALDELDAAILRLAGEAKFGA

SEQ ID NO: 8739 - protein, 524 aa, Enterococcus flavescens
MAKEIKFAEDARAAMLRGVDKLADTVKVTLGPKGRNVVLEKSYGSPLITNDGVTIAKEIELEDHFENMGAKLVSEVASKTNDIAGDGTTTATLLTQAIVREGLKNVTAGANPLGIRRGIEMATKVAVEELHNISSIVDSKEAIAQVCAVSSGSEKVGQYIADAMEKVGNDGVITIEESKGIETELDVVEGMQFDRGYLSQYMVTDNDKMEAALENPYILITDKKISNIQDILPLLEQILQQSKPLLIIADDVDGEALPTLVLNKIRGTFNVVAVKAPGFGDRRKAMLEDIAILTGGTVITEDLGLELKDATIDNLGQASKVVVDKDNTTIVEGAGEKEAIDARVQLIKNQIADTTSDFDREKLQERLAKLAGGVAVIKVGAPTETELKELKLRIEDALNATRAAVEEGMVSGGGTALVNVINKVAEIETDGDAATGVKIVLRALEEPVRQIAENAGYEGSVIIDKLKNADLGVGFNAATGEWVNMLEAGIVDPTKVTRSALQNAASVAALLLTTEAVVADKPEP

SEQ ID NO: 8740 - protein, 590 aa, Asparagus officinalis
MCGILAVLGCSDDSQAKRVRVLELSRRLKHRGPDWSGLCQHGDCFLSHQRLAIIDPASGDQPLYNEDKSIVVTVNGEIYNHEELRRRLPDHKYRTGSDCEVIAHLYEEHGEDFVDMLDGMFSFVLLDTRNNCFVAARDAVGITPLYIGWGLDGSVWLSSEMKGLNDDCEHFEVFPPGNLYSSRSGSFRRWYNPQWYNETIPSAPYDPLVLRKAFEDAVIKRLMTDVPFGVLLSGGLDSSLVAAVTARHLAGSKAAEQWGTQLHSFCVGLEGSPDLKAAKEVAEYLGTVHHEFHFTVQDGIDAIEDVIFHIETYDVTTIRASTPMFLMARKIKSLGVKMVISGEGSDEIFGGYLYFHKAPNKEEFHHETCRKIKALHQYDCLRANKATSAWGLEARVPFLDKEFMDVAMSIDPESKMIKPDLGRIEKWVLRKAFDDEENPYLPKHILYRQKEQFSDGVGYSWIDGLKAHAAKHVTDRMMLNAARIYPHNTPTTKEAYYYRMIFERFFPQNSARLTVPGGPSIACSTAKAIEWDARWSNNLDPSGRAALGVHDSAYDPPLPSSISAGKGAAMITNKKPRIVDVATPGVVIST

SEQ ID NO: 8741 - protein, 321 aa, Unknown
  Candida sp. GCY 2005
MTTSSTIKLNSGYEMPIVGFGCWKVTNETAADQIYNAIKIGYRLFDGAQDYGNEKEVGEGINRAIKDGLVKREELLITSKLWNNFHDPKNVELALDKTLSDLNLGYLDLFLIHFPIAFKFVPIEEKYPPGFYCGDGNNFHYENVPLLDTWKALEKLVQKGKIRSIGISNFTGALIYDLIRGATIKPSVLQIEHHPYLQQPKLIEYVQKQNIAITAYSSFGPQSFLELESKRALDTPTLFEHKTIKSIAEKHGKTPAQVLLRWATQRNIAVIPKSNNPARLAQNLSVVDFDLSKEDIQEISALDIGVRFNDPWDWDNIPIFV

SEQ ID NO: 8742 - protein, 62 aa, Glycine max
  misc_feature (5)..(5): Xaa can be any naturally occurring amino acid
  misc_feature (18)..(18): Xaa can be any naturally occurring amino acid
  misc_feature (35)..(36): Xaa can be any naturally occurring amino acid
  misc_feature (54)..(54): Xaa can be any naturally occurring amino acid
DAQNXVDHLSGFNVANRXLIVLYYQPAKMSKKSDXXKKEDEITRLQEKYGIGSXTPGPGSSD

SEQ ID NO: 8743 - protein, 358 aa, Canotia holacantha
ESQKLAVRAISHLQSLPGGDIKLLCATVVESVRDLTGYDRVMVYKFHEDEHGEVVAESKRPDLEPYIGLHYPATDIPQASRFLFKQNRVRMIVDCCASPVGVIQDDGLMQPLCLVGSTLRAPHGCHAQYMENMGSKASLAMAVIINGKDEEIVGGRNATRLWGLVVCHHTSARCIPFPLRYACEFLMQAFGLQLNMELQLAAQLSERHVLKTQTLLCDMLLRDSPTGIVTQSPSIMDLVKCDGAALYYQGKYYPSGVTPSEAQIKDIVEWLLAFHGDSTGLSTDSLADAGYPGAAFLGDAVCGMAVAYITNRDFLFWFRSHTTKEIKWGGAKHHPEDKDDGQRMHPRSSFKAFLEVVK

SEQ ID NO: 8744 - protein, 372 aa, Zea mays
  misc_feature (188)..(188): Xaa can be any naturally occurring amino acid
  misc_feature (338)..(338): Xaa can be any naturally occurring amino acid
ARNSARATMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRXITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKXKGDTLEFHKFYKNLSKTLKDVVWKSDDLQTQHAS

SEQ ID NO: 8745 - protein, 466 aa, Leifsonia xyli
MRKTNADDRPAVVWFRDDLRLADNPALHAAAESGRPVICLYVWDEDSPGLRSPGEAARWWLHHSLTSLEESIGRAGSALAIRTGPAERVLAEVLAEVDAGAVFWNRRYGEGERRVDERVKSAARDTGLVANSFGANLLFEPWTVRTGSGTAFSVYTPFWRACLARPEPRRPLPALRRLRPGPSLPSLELDELKLLPVHPDWADGLRETWKPGERAAHRELSAFLGEGLARYRAERDVPGIAATSRLSPRLRWGELSPFQVWHATAAARDRSTAEGAATFLSELGWREFAYHTYFERPALATVNIHREYDSFPWPRLHPSALRAWQQGRTGVPLVDAGMRELWRTGVMHNRVRMVAASFLTKNLLIDWRRGEQWFWDTLVDADPASNPFNWQWVAGSGADTAPYFRVFNPEVQREKFDPHGDYVRRWVPEWDTADYPEPLVDLAETRRAALAAWETVKAARGTAERS

SEQ ID NO: 8746 - protein, 374 aa, Canotia holacantha
ALSIAGAVESQKLAVRAISHLQSLPGGDIKLLCATVVESVRDLTGYDRVMVYKFHEDEHGEVVAESKRPGLEPYIGLHYPATDIPQASRFLFKQNRVRMIVDCCASPVGVIQDDGLMQPLCLVGSTLRAPHGCHAQYMENMGSKASLAMAVIINGKDEEIVGGRNATRLWGLVICHHTSARCIPFPLRYACEFLMQAFGLQLNMELQLAAQLSEKHVLKTQTLLCDMLLRDSPTGIVTQSPSIMDLVECDGAALYYQGKYYPSGVTPSEAQTKDIVEWLLAFHGDSTGLSTDSLADAGYPGAAFLGDAVCGMAVAYITNRDFLFWFRSHTTKEIKWGGAKHHPEDKDDGQRMHPRSSFKAFLEVVKSRSLSWEN

SEQ ID NO: 8747 - protein, 653 aa, Caulobacter crescentus
MNAATLVDTHAVDTALQEAFEAAPEGFALFDAEDRCVIWNARYGELWSKWGVTLAVGATFESLLLAGLAAGRFPEANGDRAAWLAHQLGRRKLDRIEEIREEFGEYLRFESRRTPAGGLITTCANLTNLRRREAQALAARSFLDTIVENTPAMLFVKDGDTGAFLLVNRAAENQLGVPRAELLGKSDYDFFPKEQADAFAADDRRVIASGKLVTIDEEPLDTPHNGRRWLQTRKIAIPGEDGRRHLLVICEDITERKAGAAALAEALQKAEAGSVAKSEFLANMSHEIRTPLNGVIGMAEVLSRTALDDAQREMMEVILNSGRALNLLLSDILDLSKIEAGGLELSRDPLDLREAITAAVAVFKAVAESKGLVFRLTFADDFHDHVLGDALRVRQIVANLTSNAVKFTTAGSVIIEARTLVAEDGRIDLTVSVQDTGEGFDEDSADRLFERFQQADGSVTRKVGGTGLGLPIARRLARLMDGEISCVAHPGEGATFVFEALFLADGQRTPAASADPAGELALDRRLRVLLAEDHPTNQKVIGLMLADAADVTVAEDGQAAVEAFEKHAYDVVLMDTQMPVMDGLAAIAEIRRREREAQARRTPIISLTANAMPHQVRACLEAGADLHLAKPVSIQGLFATLGAALETRPGGEG

SEQ ID NO: 8748 - protein, 374 aa, Catha edulis
ASSIAGAVQSQKLAVRAISQLQSLPGGDIKLLCDTVVESVRDLTGYDRVMVYKFHEDEHGEVVAESKRPDLEPYIGLHYPASDIPQASRFLFKQNRVRMIVDCRASPVRVIQDDGLMRPLCLVGSTLRAPHGCHAQYMENMGSLASLAMAVIINGNDEEVTGGRNPTRLWGLVVCHHTSARCIPFPLRYACEFLMQAFGLQLNMELQLAAQSLEKHVLKTQTLLCDRFLRDPPTGIVTQSPSIMDLVKCDGAALYYQGNYYPLGVTPTEVQIKDIVEWLLAFHGDSTGLSTDSLADAGYPGAALLGDAVCGMAVAYITNKDFLFWFRSHTAKEIKWGGAKHHPEDKDDGQRMHPRSSFKAFLEVVKSRSLPWEN

SEQ ID NO: 8749 - protein, 546 aa, Piscirickettsia salmonis
MSAKEVRFGTGSRQKMLDGVNLLANAVKVTLGLRGRNVILEKSFGAPTITKDGVSVAKEIELSDKFENMGAQMVKEVASKSNDDAGDGTTTATVLAQAIIQEGVKSVAAGMNPMDLKRGIDKATIAAVAALKDLSTPCTDNKAIAQVGTISANSDEEIGSIIAKAMEKVSTDGVITVEEGSSLENELDVVEGMQFDRGYLSPYFVNKQEKMIAEIESPFILLVDKKISNIRELLPTLESVAKSGKPLFIIAEDVEGEALATLVVNNIRGIVKVCAVKAPGFGDRRKAMLEDIAILTGGTVISEEVGLDLEKATLEHLGTAKRIVVTKDNTTVIDGAGEQTAIEARVTQIRAQVEETSSDYDREKLQERVAKLSGGVAVIKVGAATEIEMKEKKDRVDDALHATRAAVEEGVVPGGGVALVRAMAAVKALDFANDEQAQGANILLRAMSAPLRQIVENAGSEAAVILDKIVNGEGNFGYNAATNEFGDMIEMGILDPTKVTRSALQNAASIAGLMITTEAMVAELPKEDSAGGAGMPDMGGMGGMGG

SEQ ID NO: 8750 - protein, 374 aa, Celastrus orbiculatus
ALSIAGAVQSQKLAVRAISRLQSLPGGDIKLLCDTVVESVRDLTSYDRVMVYKFHEDEHGEVVAESKRPDLEPYFGLHYPSTDIPQASRFLFKQNRVRMIADCRASPVGVIQDDGLMQPLCLVGSTLRAPHGCHAQYMENMGSRSSLAMAVIIHGNDEEVIGGRNATRLWGLVVCHHTSVRCIPFLLRYACEFLMQAFGLQLNMELQLAAQLSEKHVLKTQTLLCDMFLRDSPTGIVTQSLSIMDLVKCDGAALYYQGKYYPIGVTPAEAQIKDIVEWLLTFHGDSTGLSTDSLADAGYPGAALLGDAVCGMAVAYITKRDFLFWFRSHTTKEIKWGGAKHHPEDKDDGQRMHPRSSFKAFLEVVKSRSLPWEN

SEQ ID NO: 8751 - protein, 232 aa, Cytophaga hutchinsonii
MQTFFLHRYAAHQMFTMSKGWEKFFYILTWLFQGSSYLSPYAYGVMHRLHHTYADTDKDPHSPKYSTGMFDMMWKTKNIYNDILHGRIELDPKYKKNVPYWGFIEKMGDNWFSRVAWGTAYTLFYVYFATHWWMFLLLPIHYLMGPVHGAIINWFAHKYGYVNFVVNDTAKNLLPVDFLMFGESYHNNHHKLGGRANFGVKWHEFDPAYPIILFFNAFHIIKLKRNNDLNYM

SEQ ID NO: 8752 - protein, 373 aa, Celastrus scandens
ALSIAGAVQSQKLAVRAISRLQSLPGGDIKLLCDTVVESVRDLTSYDRVMVYKFHEDEHGEVVAESKRPDLEPYFGLHYPSTDIPQASRFLFKQNRVRMIADCRASPVGVIQDDGLMQPLCLVGSTLRAPHGCHAQYMENMGSKSSLAMAVIINGTDEEVIGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPVEAQIKDIVEWLLTFHGDSTGLSTDSLADAGYPGAALLGDAVCGMAVAYITKKDFLFWFRSHTTKEIKWGGAKHHPEDKDDGQRMHPRSSFKAFLEVVKSRSLPCE

SEQ ID NO: 8753 - protein, 156 aa, Anabaena variabilis
MALVRWEPFREVESLQRQLNRLFDEIAPTGRREEEGIAFIPSAEIQETPDAVHLKVEIPGVDPKDLDVQVSPEAVSISGERKSEIKTEERGITRTEFRYGRFQRVIPLPTRVQHDQVQAEYKDGILKLRLPKAEEDRNKVVKVNLGDGHRGNGQGQ

SEQ ID NO: 8754 - protein, 503 aa, Debaryomyces hansenii
MPQDTETMYSGRVVNKVYNQDFIIDRRFKIVKELGHGAYGIVCSAKYDDGSDNEDGSYVAIKKITNIFSKKILCKRSLRELKLLQFFRGHKNITCLYDLDIIPNPITGEFNEIYLYEELMECDMHQIIRSGQHLTDSHYQSFIYQTLCGLKYIHSADVLHRDLKPGNLLVNADCELKICDFGLARGFLECPEQNVGFMTEYVATRWYRAPEIMLSFTNYTKAIDIWSVGCILAELLGGKPIFRGKDYVDQLNQILLILGTPKESTLTKIGSVRAQNYVRSLPFMRKVHYSELFPTANPLALDLLEKMLTLDPYERITVEEALNHPYLSVWHDPQDEPECQIKFDFKSFETVDDMKSMKNLIIDEVKNFRDFVRKPLQEQQQIQLQMQIQQQEREKQKNDSMDLSTPINQQQFNEMLSSSSNSNSNSNSNPETGVNTDTPKMTNDNDLQYYQSIPKPQELDEFTFSHNSKGLSPTDNNDNHTDLFRLEEELGFGLDGAGMFNNI

SEQ ID NO: 8755 - protein, 357 aa, Anabaena variabilis
MDLFTPLIIRDITLPSRVAMSPMCQYSAENGFANDWHFVHLGSRAVGGTGLIMVEATAVTPQGRITPGDLGLWDDKQIEPLTRIVRFLRQQGSVTGIQLAHAGRKASCNVPWLGGTPLTPEQGGWQPVAPSPIPFQENAPVPISLDERGIQETIFAFVAAAQRALQVGFQMIEIHAAHGYLLHSFLSPLSNRRTDRYGGSLENRMRLLLEVVRRVRDVLPNGMPLFVRISATDWVEGGWDLQQSIILSRELKTLGVDLIDVSTGGLVPHARIPVEKGYQVPFAAKIREEAGIMTGAVGLINEAEYADQIITRGCADLVLIGRELLRNPYWSIYARCSLDEEPNWPVPYGYAVKRQRR

SEQ ID NO: 8756 - protein, 376 aa, Oryza sativa
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 8757 - protein, 395 aa, Legionella pneumophila
MVFGFLNLSFWGYVLATFILTQITIASVTIYLHRNQTHRALTLHPVVSHFFRFWLWLTTGMVTADWVAIHRKHHATTDVEGDPHSPVVEGIRKVFWQGAELYREARKDRDMVAKYSHGTPTDWIERNVYSRHSSKGILLMLLLDLFFFGIPGMTVWAIQMMWIPLFAAGVINGIGHYWGYRNFECPDAATNIIPWGFWIGGEELHNNHHTFASSAKFSVKWWEFDIGWMYIRILSLFGLAKVKKLPPKLAMDEGKFHVDLDTVRAVISNRFQVMSYYYKNVIRPILKHEKNTSIETKEDKKLFQRAGRLLRREDKLLSTKAKTRLQKLLDAREQLRVVYSYKQSLQNVWLKTATTQKELVEALQQWCRQAEESGLDVLKQFAQQLKGYVPVYTRE

SEQ ID NO: 8758 - protein, 377 aa, Triticum aestivum
  misc_feature (179)..(179): Xaa can be any naturally occurring amino acid
  misc_feature (197)..(197): Xaa can be any naturally occurring amino acid
  misc_feature (205)..(205): Xaa can be any naturally occurring amino acid
  misc_feature (321)..(321): Xaa can be any naturally occurring amino acid
MGREKSRRLSGSRDFRQRLVLAMLTSTPIIIKDVRAGEGGLRPHEMSLLHLLDKVSDQHVIDVNDTGTKVGYKPGVVLGGKDLEHDCGVHRGIGYFIEPLILLGLFARSPLSIRLKGITNDTKDPSVDTFRMVTLHMLKHFGVPLRPPRPEIESRGAPPRGGGEVLLRVPNINSTLKGXNGIDEGMVKRIRGVAFSXTNVSPQIXTRILYAARGLFNKFIPDVHIFTDHRAGLSGGLSAGYGVSVVAETTTGCLISADATVSYPNVDEMSEQSKKPELMSPEDLGEQVASMLLEEVAQGGVVDSTHQGLLFMLCALCPPDXVSKVRVGQLTPHAIESLRNIKEFLDVKFIIKPDPNSNTVTLKCVGAGVKNLARKIS

SEQ ID NO: 8759 - protein, 349 aa, Sinorhizobium medicae
MSGATLEAYLASCTTHGDELSRDVAAVIQRLAKAALDIRKLVNQGALGTVFNGMHSGSNTDGDVQKDLDILCDDQFLSCLQGAPVACYASEELENPVLLDPAARLAVAIDPLDGSSNIDNNISIGTIFSVLPAAKGPDVDPSHSFLQPGNRQLAAGFFVYGPQTALVLSLGRGTDIFIFSSRLGCFVDAYKSVGIPDRANEFAINMSNYRHWEEAIRLYVDDCLAGSEGPRERDFNMRWIASLVAEAYRILVRGGIFLYPADSRKGYSHGRIRLVYEANPIAFIVENAGGSATTSVDRILDLVPESLHQRVPLVFGSRREVGRITRYHVDPNMIGERAPLFGKRGLFRA

SEQ ID NO: 8760 - protein, 187 aa, Arabidopsis thaliana
  misc_feature (38)..(38): Xaa can be any naturally occurring amino acid
  misc_feature (56)..(56): Xaa can be any naturally occurring amino acid
  misc_feature (78)..(78): Xaa can be any naturally occurring amino acid
  misc_feature (104)..(104): Xaa can be any naturally occurring amino acid
  misc_feature (129)..(129): Xaa can be any naturally occurring amino acid
  misc_feature (154)..(154): Xaa can be any naturally occurring amino acid
CWLFSQDYRHMCRRFRAHTYTLIAKSRKILFVKLHWKXPTCAINNLTDEEAKVAGXPITLHTTKRIHDTHCLLYLPYXKLLIQTWITLYQDKVDFDPLDETKHXPEDIEPVHSPGTLILNTTIDNYLQXTEQLDFNQCLVDPGIYYSNDTLLQXRIFAYGDTHRHRLEPNYLQLTINAPICAHHINH

SEQ ID NO: 8761 - protein, 628 aa, Bordetella bronchiseptica
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIGAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGRAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDAGQTKHIFRKAMRGIVPDSILDRDDKIGFATPEQQWMQATAPQMRQWLVDAADIPFLRNAEVTAQFDAMIAGATPFSWQAWRWVNFQRWMQHATVLP

SEQ ID NO: 8762 - protein, 545 aa, Campylobacter jejuni
MAKEIIFSDEARNKLYEGVKKLNDAVKVTMGPRGRNVLIQKSFGAPSITKDGVSVAKEVELKDSLENMGASLVREVASKTADQAGDGTTTATVLAHAIFKEGLRNITAGANPIEVKRGMDKACEAIVAELKKLSREVKDKKEIAQVATISANSDEKIGNLIADAMEKVGKDGVITVEEAKSINDELNVVEGMQFDRGYLSPYFITNAEKMTVELSSPYILLFDKKIANLKDLLPVLEQIQKTGKPLLIIAEDIEGEALATLVVNKLRGVLNISAVKAPGFGDRRKAMLEDIAILTGGEVISEELGRTLESATIQDLGQASSVIIDKDNTTIVNGAGEKANIDARVNQIKAQIAETTSDYDREKLQERLAKLSGGVAVIKVGAATETEMKEKKDRVDDALSATKAAVEEGIVIGGGAALIKAKAKIKLDLQGDEAIGAAIVERALRAPLRQIAENAGFDAGVVVNSVENAKDENTGFDAAKGEYVNMLESGIIDPVKVERVALLNAVSVASMLLTTEATISEIKEDKPTMPDMSGMGGMGGMGGMM

SEQ ID NO: 8763 - protein, 364 aa, Celastrus scandens
VQSQKLAVRAISRLQSLPGGDIKLLCDTVVESVRDLTSYDRVMVYKFHEDEHGEVVAESKRPDLEPYFGLHYPSTDIPQASRFLFKQNRVRMIADCRASPVGVIQDDGLMQPLCLVGSTLRAPHGCHAQYMENMGSKSSLAMAVIINGTDEEVIGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPVEAQIKDIVEWLLTFHGDSTGLSTDSLADAGYPGAALLGDAVCGMAVAYITKKDFLFWFRSHTTKEIKWGGAKHHPEDKDDGQRMHPRSSFKAFLEVVKSRSLP

SEQ ID NO: 8764 - protein, 289 aa, Nicotiana tabacum
MKMEALDPSAASCFMVDVDDDLLNFSLEDETVFDDDEKTTKSITKHKHPLSSSYSSSLDSSNPVLSLLPSQQHPECVEEELEWLSNKDAFPAVEFGILADNPSIVFDHHSPVSVLENSSSTCNSSGNGSANANAYMSCCASLKVPVNYPVRARSKRRRRRQRGSFADLPSEHCMSVNKPSFKSVKQREPLLSLPLNSAKSASIGRRCQHCGADKTPQWRAGPLGPKTLCNACGVRYKSGRLLPEYRPANSPTFSPTVHSNSHRKVLEMRKQKIGVGGMMIHEACGYRVG

SEQ ID NO: 8765 - protein, 370 aa, Celastrus scandens
ALSIAGAVQSQKLAVRAISRLQSLPGGDIKLLCDTVVESVRDLTSYDRVMVYKFHEDEHGEVVAESKRPDLEPYFGLHYPSTDIPQASRFLFKQNRVRMIADCRASPVGVIQDDGLMQPLCLVGSTLRAPHGCHAQYMENMGSKSSLAMAVIINGTDEEVIGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPVEAQIKDIVEWLLTFHGDSTGLSTDSLADAGYPGAALLGDAVCGMAVAYITKKDFLFWFRSHTTKEIKWGGAKHHPEDKDDGQRMHPRSSFKAFLEVVKSRSL

SEQ ID NO: 8766 - protein, 374 aa, Crossopetalum rhacoma
ALSIAGAVQSQKLAVRAISQLQSLPGGDIKLLCDTVVESVRHLTGYDRVMVYKFHEDEHGEVVAERKRPDLEPYIGPHYPATDIPQASRFLFKQNRVRTIVDCHASPVRVIQDDGLMQPLCLVGSTLRAPHGCHAQYMENMGSIASLAMAVIINGNDEEVIGGRNTTRLWGLVVCHHTSARCIPFPLRYACEFLMQAFGLQLNMELQLAAQLSEKHVWKTRTLLCDMLLRDSPTGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVKSRSLPWEN

SEQ ID NO: 8767 - protein, 483 aa, Zea mays
MSYNKAPSITAETINPRVKIIRYAPCGEIVKHAARLEQEIEENPASIPFQEVKTPPLCSKQVLSLCDNPALMDRDEARALFSPCSIRRARRILNSIPSKDTGGYTDCRGIKCLRQVVADGITARDGFPSTADDIFLTDGATSAINLMMQILIRSHEDGILSPLPEYPLYSASIILHGGTMVPYNLTEDNGWGLEIFEVKRCLEEARSAGLTVRAMVVINPGNPTGQVLSVTNQEEIVEFCRKEGLVILADEVYQENIYAENKKFHSFKKVARSLAYDENDLTLVSLHSVSMSYGESGRRGGYMEVSGVAANVKDQIYKVASLTLCPNIAGQILVSLAMDPPKLGDESFESFDKEKEQIRSSFCKRAKTLEKAFSGLEGVTCNKLEGALYLFPRLHLPSAAIRAADFEGVSPDIFYAHRLLDATGIAVVPGSGFHQASGTIHIRCTILPDERKIEAMVARLRAFHKAFMNEFRGSQQVMNDLRR

SEQ ID NO: 8768 - protein, 374 aa, Crossopetalum rhacoma
ALSIAGAVQSQKLAVRAISQLQSLPGGDIKLLCDTVVESVRHLTGYDRVMVYKFHEDEHGEVVAERKRPDLEPYIGPHYPATDIPQASRFLFKQNRVRTIVDCHASPVRVIQDDGLMQPLCLVGSTLRAPHGCHAQYMENMGSIASLAMAVIINGNDEEVIGGRNTTRLWGLVVCHHTSARCIPFPLRYACEFLMQAFGLQLDMELQWRAQLSKKHVWKTRTLLCDMVLRDSPTGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVKSRSLPWEN

SEQ ID NO: 8769 - protein, 178 aa, Triticum aestivum
  misc_feature (33)..(33): Xaa can be any naturally occurring amino acid
  misc_feature (95)..(95): Xaa can be any naturally occurring amino acid
  misc_feature (99)..(99): Xaa can be any naturally occurring amino acid
  misc_feature (151)..(151): Xaa can be any naturally occurring amino acid
MVLSHAASAGSSDDSVHSTFASRYVRASLPKFXMPENSIPKEAAYQIINDELMLDGNPRLNLASFVTTWMEPECNKLMMDSINKNYVDMDEYPSXELQXRCVNMIAHLFNAPPGETRTPWGWAPSGFWRAHLSAGVGFRRGWGKKIKAAGXPFKKPKFYRGKISILWEKISPPFLRGA

SEQ ID NO: 8770 - protein, 374 aa, Cuervea integrifolia
ALSIAGAVQSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGIGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIRDIVEWLLAFHGDSTGLSTDSLADAGYPGATLLGDAVCGMAVAYITNRDFLFWFRSHTAKEIKWGGAKHHPEDKDDGQRMHPRSSFKAFLEVVKSRSLPWEN

SEQ ID NO: 8771 - protein, 378 aa, Solibacter usitatus
MRPNEGWEGVWSSYLTVRSGSTCDTEQMLLTPLTLREVTLRNRIGVSPMCQYSSEDGFFNDWHLVHLGSRAAGGAGLVCTEATAVVPEGRISPHDAGIWKDEHIEFLTRITAFLHRHSAVAGIQLAHAGRKASVRRPWEGGTAIRESEGGWQAVAPSEIPFRDTDPTPHALSAGEIQGLVEAFAKAARRALQAGFDVVEIHGAHGYLIHEFCSPLSNQRTDQYGGSLVNRIRFALEVTEAVRSVWPAGLPVLYRISATDWVEGGWSPDDSVELARALKARGVDLIDCSSGGNSTAQKIPLVPGYQVPYAEKIRREAEIPTAAVGMITTAEQAEGIVSEGKADLVLLAREFLRDPYFPLHAAAELGEKPSPPLQYARAF

SEQ ID NO: 8772 - protein, 605 aa, Unknown
  Malus x domestica
MESCDCIDAQWPPDELLVKYQYISDVFIALAYFSIPLELIYFVQKSAFFPYRWVLVQFGAFIVLCGATHFINVWTFSMHTKTVAIFMTVAKVSCAVVSCATALMLVHIIPDLLSVKKRELSLKSRAEELDKEMGLMLTQEETGRHVRMLTHEIRSTLDRHTILKTTLVELGRTLGLQECALWMPSRTGMNLQLSHTLNYHIQAGSSVSMDLPVVNEVFNSSRAIRIPYTCPLARIRPLVGRYVPPEVVALRVPLLNLSNFQINDWPDVSAKSYAIMVLILPTDGTRKWREHELELVDVVPDQVAVALSHAAILEESMRARKQLTEQNDALDLAWREAEMAIHARDDFLAVMNHEMRTPMHAIIALSSLLLDTELTPEERLMIETALKSSNLLETLVNDELDLSRLEDDSLELDTERFNLHGVFREVMNLVQPVASVKKLSMTLIQSPDLPVYAVGDENRLLQTILNVAGNAVKFTKQGYISITASVAKSESSRDWQPSEFYPASTDGYFYLRVQVKDSGCGVLPEDIPHLFTKLSQPRNGSNQININNGAGLGLAICKRFVNTMGGHIWIESEGIDRGSIVAFIVQLGICDNHSDTTTHQVQIAT

SEQ ID NO: 8773 - protein, 738 aa, Unknown
  Mesorhizobium sp. BNC1
MSAAADAAPWRLDDPHVIGALVAGRLADPFAILGPHQTAAGLVLRVLRPEADTAEAIDPDSGSSYGKLLKRHARGFFEGLISKNTAVPRYRLRFTREGDTWDEEDAYRFPSTFGDLDLYLLGEGRHQRLYEKLGAHPMACDGVDGTRFAVWAPNASRVSVVGNFNNWDGRRHQMRLHPGIGVWEIFVPGAKPGNLYKYEIIGRNGELLPPKADPVGFRAEVPPATASVVNGLPQMEWGDGEWVEHRIGKNDRKAPISIYEVHLGSWRRHEDGRYLSYDELADRLLPYVKDLGFTHIECMPVSEHPFSGSWGYQPVGLYAPTSRFGTPEDFARFVDRCHHEGIGVIIDWVPAHFPSDAHGLARFDGTALYEHEDPRLGFHRDWNTLIYNFGRREVANFLTANALFWLDRYHVDGLRVDAVASMLYLDYSRQPGEWIPNKHGGNENLEAIAFLRETNTALFGSHPGTTSIAEESTAFPGVSRPVYAGGLGFGFKWNMGWMHDTLDYMQHEPIHRQHHHDRMTFGLIYAFSENFILPLSHDEVVHGKGSLIGRMPGDRWQKFANLRAYFTFMWTHPGKKLLFMGGEFAQEREWNHDWQLDWHHLDDPMHRGVHDLIRDLNRIYRSEPALHELDCEPEGFEWIDASDPSISTYVYMRKGTGGARPVVVACNFTPVVRENFRIGLPNAGIWREILNSDDRRYGGSDVTNGTVTATTDEPWHGRPASAILRLPPLGSVVLVGEA

SEQ ID NO: 8774 - protein, 635 aa, Unknown
  Mesorhizobium sp. BNC1
MAGLGGHAFSAHAGTRRPFDGCAGRPCTMTHTTFQTRWGAQLQDDDTALFRLWAPAADQLRLRFGGGEERAMERGQGGWFELEIGGLAAGTPYQFVLPDGTAVPDPASRAQAGDVHGPSLLTSRDFNWGVKDWKGRPWEEAVVYELHPGTFSPEGGSGGIRRKLDYLAEVGFTAIEIMPVAQFSGNRGWGYDGVLPYCPHSAYGGVAGLKELVDAAHERGLMMILDVVYNHFGPDGNYLSLYAPDFFDPSRDTPWGPAIRFEEPAVRAFFLDNPIYWLEEFRFDGLRFDAIDQIKDRSETPILQEIARAIRSRYPDRHIHLMTEDERNIVELHPRDDANRPILFTAEWNDDFHHAAHCVATGEDTGYYAAFADDPAGHLARALAEGFCYQGEPYAPREGKPRGVPSAGQPPAAFVDFLQNHDQIGNRAFGERLTALADADTVELLTAVLLLNPQIPLAFMGEEFGETNPFLFFTDFHGDLAKAVREGRRHEFKDFGHFSGEQAEQIPDPNALSTFEASMLDWDRVETEAGRKRLDLFRRLLQVRKVHLLPHLSDMTSMQGHSTRLGEKALSVRWRMSDRVLVMAANFGTAAVDTADGFVGCKAIYESRKGVEAALLQGELPERSVAVLITEEAGT

SEQ ID NO: 8775 - protein, 683 aa, Unknown
  Shewanella sp. MR-4
MRKLTLATSIATVFVGFSAWAVPPTIQISELPTLKQEAQHKVASKRVTDLYTRSHYHRFALDDAFSAQIFDRYLQQLDYRRNVLTQADVDSFKPYVNQFDDMLSSGELEPAYKMFDLVQKRRYEGFVYALSLLDKEMDFTVPGDAYEYDREDVAWPKDQAEINELWRQRVKYDALNLKLTGKKWPEIVDILQKRYNNAIKRLTQTNSEDVFQAVMNAFSRSIEPHTSYLSPRNAERFQMEMNLSLEGIGAQLQLEDDYTVIKSLIAGGPAASSEKLSPEDKIVGVGQEGGEIVDVIGWRLDDVVDLIKGPKGSKVVLQILPKKGGSNAKPFNLTLVRDKIRLEDRAATSKIIEPKDGEYANRKVGVIQIPGFYMNLSQDVEKELVKLNEAKVEGVVIDLRGNGGGALTEAVLLTGLFIDMGPVVQVRDADGRVSAHRDNDGKTTYAGPLTIMVDRYSASASEIFAAALQDYDRALIVGESSFGKGTVQQHKSLGRIYDMYEKPIGHVQYTIQKFYRINGGSTQLKGVTPNIAYPSALEPGEYGEAEEKNALPWDKVPMAQYGTLNDITPELVASLDKKHLARIQNNVEFNYINQDIADFKKHHKEKTVSLVESERIASREADEKKVLDRTNERRVAHGLAAVKSMEDIKDKDDIEAPDAFLDETAYITLDMADAKKLANAGTK

SEQ ID NO: 8776 - protein, 384 aa, Legionella pneumophila
MMFGFLNMTLWGYLLTGFVLTHITTTAVTIYLHRYQTHRALTLHPLVSHFFRFWLWLTTGMTTAEWVAIHRKHHANTDMEGDPHSPQVFNIRKVFWQVPELYREASKDKDMIKKYSYGTPNDWIERKLYSPHANKGIFLMLALNLFLFGIPGLTLWAIQMMWIPLVAGVVNGIGHYWGYRNHESSDSSTNVFPWGLLIAGEELHNNHHTFASSAKFSIKWWEFDLGWFYIRCLSFLKLAKVKKLPPKLIIDKNKSHIDVDSVKAILGNRFQVISDYYKLVIFPTLRDMQYRIKNRDLKNARHLLKKPNEQLSHADQLRLKTLLKQHDNLQAVHNYRELLQQIWLKTSLSNKDLLNLIQKWCSQAEESGLLVLRQFASQLKSYSL

SEQ ID NO: 8777 - protein, 210 aa, Asarum europaeum
GGLLKKARELAILCDAQLGVIIFSSSGKMFEFSSPPISMREIIDRYQKLSGNCAPVYDNQQVYCEITRMKNEIDKLQATMRHFAGEDLTSLTMNEMLQLEQQLEISVNKVRSRKEQLLQQQLDNLRRKENMLEEQNRELYRVIQDHHAASMEQKMVDPSMLDHFGVFYQDDHQAARSSMLQLSPQLHPFRLQPAQPNLQDANLLPHDLQL

SEQ ID NO: 8778 - protein, 222 aa, Brassica napus
  misc_feature (166)..(166): Xaa can be any naturally occurring amino acid
  misc_feature (193)..(193): Xaa can be any naturally occurring amino acid
  misc_feature (212)..(212): Xaa can be any naturally occurring amino acid
MGKGPLSFRRLSSIRRRKKGSSVKDDPNQSSNPSSPPPPSPINAGGSVAAGTTGKVKKKAGGARLWMRFDRTGAMEVVECDKSTIIKRSSVPARDLRILGPVFSHSSNILAREKAIVVNLEVIKAIVTAEEVLLLDPLRPEVLPFIDRLKQQFPQRNALEATPNVXTFDPEAGEGLQSELPFEFQVLEMALEXVCSIVDTSVASLETDAWPXLDELTKNVST

SEQ ID NO: 8779 - protein, 210 aa, Neisseria meningitidis
MTLRYEILSVTPFRQNCTLIWDDESGEAVLTDVGGDVPFLLQALANRKLTLTAIWLTHGHLDHAGGVVEMLKTHKVPVLGPHPDDEFLLQSLPQTTAQYGFPVSPAFAPNRWLEEGETLTVGRYAFQVLHIPGHTPGHIVFYCAEAELLIAGDVLFYETIGRTDFPRGNHADLINNIRNKLFALPETVQVVAGHGRMTSIGHEKRHNPFF

SEQ ID NO: 8780 - protein, 474 aa, Desulfotalea psychrophila
MLRCYPRTEKEKRMPLHNKRKNNIMDDIYASSDLSIVLPKYKMPQKELDPRHAYQMVHDELMLDGNARQNLATFCQTWDDPEVHRLMDECIDKNMIDKDEYPQTAEIESRCVHILADLWNAPDSANSLGCSTTGSSEAAMLGGLALKKRWSEKRKAAGKGTDRPNIVCGPVQICWHKFARYWDVELREVPLEDQLYMTAEEAVKRCDENTIGVIPTLGVTFTCVYEPVEEICRALDQLQKETGLDIPVHVDGASGGFLAPFVDPDLKWDFRLKRVKSINASGHKFGLAPLGVGWVLWRDKEELPEDLIFWVNYLGGNMPTFALNFSRPGGQIIAQYYNFLRLGHEGYRKIHQACYKTAQYLSSEVKKLGPFEIIYDGRGGIPAMSFSLQEGVAPGFNLFDLSDRIRSRGWQIAAYSMPANREDLVVMRILVRHGFSRDLADLLLKDLQHCLEYFKKNPVIHQSSEEFSGSFKHS

SEQ ID NO: 8781 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 8782 - protein, 581 aa, Glycine max
MVPSSFRPFISDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDSIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDALKAHPPKHVTEKMMLNAGNIYPHNTPKTKEAYYYRMIFERFFPQNSARLTVPGGASAACSTAKAVEWDAAWSNNLDPSGRAALGVHISAYENQNNKGVEIEKIIPMDAAPLGVAIQG

SEQ ID NO: 8783 - protein, 442 aa, Bradyrhizobium japonicum
MLDETAGRAPGGAARWWLAQSLRALGAEIAARGGSLILRKGPAAGVIPEEARESGARAVYWNGIAQAPHQAIERRLEAALAKLGVDSQSFPGDLLVPPSAIRNKEGRGLRVFTPFWRRVLSLGDPPKPLPAPKQLRPGPKIVSDRLESWQLAPTKPDWAGGLRERWTPGEASARARLRDFLKTIARGYAGDRDRPDRVGTSGLSPHLRFGELSPRQVWHAARFAAAEDAALGPGIEKFLSELGWREFCRHLLHDHPDLATENLQTNFDGFPWQSDGKVLAAWQRGRTGYPIVDAGLRELWHTGVMHNRVRMVVASFLVKHLLIDWRDGEAWFWDTLVDADAGSNPANWQWVAGCGADAAPYFRVFNPQLQGEKFDPDGTYVRRWVPELQGLPAKLIHQPWQATPNELASAGVTLGKTYPQPIVDHARGRERALSAYAKIRKG

SEQ ID NO: 8784 - protein, 363 aa, Cuervea kappleriana
SQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGIGGRNATRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIRDIVEWLLAFHGDSTGLSTDSLADAGYPGATLLGDAVCGMAVAYITNRDFLFWFRSHTAKEIKWGGAKHHPEDKDDGQRMHPRSSFKAFLEVVKSRSLPG

SEQ ID NO: 8785 - protein, 364 aa, Dicarpellum baillonianum
VQSQKLAVRAISQLQSLPGGDIKLLCDTVVECVGDLTGYDRVMVYRFHEDEHGEVVAESKRPDLEPYLGLHYPATDIPQASRSLFKQNRVRMIVDCHASPVRVIQDDGLMQALCLVGSTLRAPHGCHAQYMENMGSIASLAMAVIINVNDEEATAGRNPTRLWGLVVCHHTSARCIPFPLRYACEFIMQAFGLQLNMELQLAAQLLEKHVLKTQTLLCDMLLRDSPTGIVTQSPSIMNLVKCDGAALYYQGNYYPLGVTPAEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSLP

SEQ ID NO: 8786 - protein, 362 aa, Dicarpellum baillonianum
QSQKLAVRAISQLQSLPGGDIKLLCDTVVECVGDLTGYDRVMVYRFHEDEHGEVVAESKRPDLEPYLGLHYPATDIPQASRSLFKQNRVRMIVDCHASPVRVIQDDGLMQALCLVGSTLRAPHGCHAQYMENMGSIASLAMAVIINVNDEEATAGRNPTRLWGLVVCHHTSARCIPFPLRYACEFIMQAFGLQLNMELQLAAQLLEKHVLKTQTLLCDMLLRDSPTGIVTQSPSIMNLVKCDGAALYYQGNYYPLGVTPAEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSL

SEQ ID NO: 8787 - protein, 548 aa, Vibrio fischeri
MAAKDVKFGNDARIKMLEGVNVLADAVKVTLGPKGRNVVLDKSFGAPTITKDGVSVAREIELEDKFQNMGAQMVKEVASQANDAAGDGTTTATVLAQAIITEGLKAVAAGMNPMDLKRGIDKAVVAAVEELKALSVPCADTKAIAQVGTISANSDSTVGNLIAEAMDKVGRDGVITVEEGQALQDELDVVEGMQFDRGYLSPYFVNNQEAGSVDLESPFILLVDKKVSNIRELLPTLEAVAKASRPLLIIAEDVEGEALATLVVNNMRGIVKVAAVKAPGFGDRRKAMLQDIAVLTAGSVISEEIGLELEKVVLEDLGQAKRVTITKETTTIIDGSGEETIIQGRVSQIRQQIEDATSDYDKEKLQERVAKLAGGVAVIKVGAATEVEMKEKKDRVEDALHATRAAVEEGVVAGGGVALIRVASKVAGLVGDNEEQNVGIRVALRAMEAPIRQITKNAGEEDSVVANNVKAGEGSYGYNAATGEYGDMIEMGILDPTKVTRSALQFAASVAGLMITTEAMVTDKPQDSGSAMPDMGGMGGMGGMGGMM

SEQ ID NO: 8788 - protein, 365 aa, Dicarpellum pancheri
QSQKLAVRAISQLQSLPGGDIKLLCDTVVECVGDLTGYDRVMVYRFHEDEHGEVVAESKRPDLEPYLGLHYPATDIPQASRFLFKQNRVRMIVDCHASPVRVIQDDGLMQALCLVGSTLRAPHGCHAQYMENMGSIASLAMAVIINGNDEEATAGRNPTRLWGLVGCHHTSARCIPFPLRYACEFIMQAFGLQLNMELQLAAQLLEKHVLKTQTLLCDMLLRDSPTGIVTQSPSIMNLVKCDGAALYYQGNYYPLGVTPAEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSLPGR

SEQ ID NO: 8789 - protein, 550 aa, Brassica rapa
LTMKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPKGKVSRGVNQGGLDYYHKLLDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 8790 - protein, 364 aa, Dicarpellum pancheri
VQSQKLAVRAISQLQSLPGGDIKLLCDTVVECVGDLTGYDRVMVYRFHEDEHGEVVAESKRPDLEPYLGLHYPATDIPQASRFLFKQNRVRMIVDCHASPVRVIQDDGLMQALCLVGSTLRAPHGCHAQYMENMGSIASLAMAVIINGNDEEATAGRNPTRLWGLVGCHHTSARCIPFPLRYACEFIMQAFGLQLNMELQLAAQLLEKHVLKTQTLLCDMLLRDSPTGIVTQSPSIMNLVKCDGAALYYQGNYYPLGVTPAEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSLP

SEQ ID NO: 8791 - protein, 461 aa, Burkholderia fungorum
MTFLKSPPPTPDAVADEYAAMISGSSLPKYRIPEASSDRRAVFDLVRDELFMDGNSRQNVATFCTTYADDEVRRLMDLSIDKNMIDKDEYPQTAEIEMRCVHMLADLWHATKSWKTTGCSTTGSSEACMLGGLALKWQWKKRREAQGKPTGKPNFVCGPVQVCWAKFARYFDVEMRQVPLSGDATGLRPEDLAQYCDENTIGVVATLGITFTCVYEPVKALAGALDALQANVGLDIPIHVDAASGGFVAPFIQPDLEWDFSVPRVKSINASGHKYGLAPLGVGWIVWRSTQDLPDELIFRVDYLGGDMPTFALNFSRPAGQIIAQYYMLLRLGREGYRHIQQECADTAQALADGLAKIDALDMIYDGRGALPAVCYKLKHPDTAGFTLFDLSDRVRMRGWQIASYELPAGREDTIVQRVLIRRGVTRDMAAMLLEDIKHAIAHLTKNPVPNSTAGPTFHHD

SEQ ID NO: 8792 - protein, 451 aa, Unknown
  Exiguobacterium sp. 255-15
MNIICWIRSDFRLEDNHMLARAVEYLEKDEQANVEFVFWVNPDYIGEYDARQQYFFQALEHFAKNCKTHDMPIRFIEGQEKDFLEATEMADVLLFNAEYVEPFKSRDDGIMKKRGDKKTERLLDRHLLHPHAVKKNDGSYYKVFTPYKNAFLKKDVDKPYPVKLNLLKERYHKRRQNNAFMLDYFKRAASDTDFAVGEETARKRLRSFLKNNLSAYEEQRDLPAVDGTSLMSRYLRTGEIGIRTIFDAVQQEQDSKGKQTYLTELIWREFYYTILMHYPESKRLPVNEQYTKIEWETDEKGFKAWAEGKTGYPIVDAAMRQLNTTGWMHNRLRMIVASFLTKDLLVDWQKGERYFQQKLVDYEAASNIGGWQWAASVGTDAVPYFRVFNPTTQSKKFDKDGTFIRTYLPELKDLPKTSIHEPTEQQRKDYDYPMPIVEHDMARKRAIARFK

SEQ ID NO: 8793 - protein, 366 aa, Eurotium herbariorum
MAEFVRATIFGTTFEITSRYTELQPVGMGAFGLVCAARDQLTGAPVAVKKIMKPFSTPVLSKRTYRELKLLKHLGHENIICLSDIFISPLEDIYSVTELLGTDLHRLLTSRPLEKQFIQYFLYQILRGLKYVHSAGVVHRDLKPSNILINENCDLKICGFGLARVQDPQMTGYVSTRYYRAPEIMLTWQKYDVEVDIWSAGCIFAEMLDGKPLFPGKDHVNQFSIITELLGTPPDDVIETICSENTLRFVKSLPKRERQPLTSRFKNADPEAVDLLERMLVFDPKKRIRAGEALAHEYLAPYHDPTDEPEAQEKFDWSFNDADLPVDTWRIMMYSEILDFHNIDQSEDAGQVLVEGVGDGQQAFAA

SEQ ID NO: 8794 - protein, 720 aa, Chlamydophila pneumoniae
MVDKLIHPWDLDLLVSGRQKDPHKLLGILASEDSSDHIVIFRPGAHTVAIELLGELHHAVAYRSGLFFLSVPKGIGHGDYRVYHQNGLLAHDPYAFPPLWGEIDSFLFHRGTHYRIYERMGAIPMEVQGISGVLFVLWAPHAQRVSVVGDFNFWHGLVNPLRKISDQGIWELFVPGLGEGIRYKWEIVTQSGNVIVKTDPYGKSFDPPPQGTARVADSESYSWSDHRWMERRSKQSEGPVTIYEVHLGSWQWQEGRPLSYSEMAHRLASYCKEMHYTHVELLPITEHPLNESWGYQVTGYYAPTSRYGTLQEFQYFVDYLHKENIGIILDWVPGHFPVDAFALASFDGEPLYEYTGHSQALHPHWNTFTFDYSRHEVTNFLLGSALFWLDKMHIDGLRVDAVASMLYRDYGREDGEWTPNIYGGKENLESIEFLKHLNSVIHKEFSGVLTFAEESTAFPGVTKDVDQGGLGFDYKWNLGWMHDTFHYFMKDPMYRKYHQKDLTFSLWYAFQESFILPLSHDEVVHGKGSLVNKLPGDTWTRFAQMRVLLSYQICLPGKKLLFMGGEFGQYGEWSPDRPLDWELLNHHYHKTLRNCVSALNALYIHQPYLWMQESSQECFHWVDFHDIENNVIAYYRFAGSNRSSALLCVHHFSASTFPSYVLRCEGVKHCELLLNTDDESFGGSGKGNRAPVVCQDQGVAWGLDIELPPLATVIYLVTFF

SEQ ID NO: 8795 - protein, 710 aa, Desulfotalea psychrophila
MKLMKSFFFSVLVLLFLSPVLHADSLTAEEQERDSLIGHMLSKQLPTLHYSDKELNDSLGEAAFSLYLKQLDYQKRFLLQEDVDVLHSHADSIDDNMRSGQVVLPSLGSEILLKRVAQVQQMVTKMVAAEIGHTPGEVYQSDPKKLSYAKSLAELEDRWRKILKAQVMSRYLDLEEEAQAAKGADLAGKKSGEGTRKSVSSNFKKMWAEATEKVAKQNKTFLHRLTQETLQDHTDRFFNSVARAFGPHTNYIPPASKEQFDINMRGSLEGIGALLKEEDGMIKVVRVIPGSASARQGGLEIEDAILSVGQGDEEPVDVSDMRLRDAVRLIRGAKGTEVRLTVRKNGGLKSVVPIIRDVVQMEDTFVKSLVVKGDDGARIGYINIPSFYRDFEKSKKGEKGRNSTDDTRVEVLKLKALGVDGIVLDLRNNGGGALVDAIDIAGLFVKEGPMVQVRTSMGDKRILFDQDEGIVYAGPLVILVNKFSASASEIVAAALQDYHRAVIMGGAHTHGKGSVQTVLDLNEYVPWLSMANYEDLGALKIMIQKFYRVNGGSTQYKGVEPDIVLPSIYEHLKSGERYLDYSLPWDSIEAIDYTTFSLSPDIEKIRKNSLVRVKKNKEFDIIRDEVAKAEERSLDTYIYLDIERMRGDRRMAKAARKRLGAEVGLLEEEPKSTISETEAEKESHWRQGVSRDPWVQEAGRVIADIGRQVS

SEQ ID NO: 8796 - protein, 492 aa, Acacia ampliceps
MDPYKYRPSSTFNTPFWTTNSGTPVYNNDSALTIGSRGPILLEDYHLVEKIANFTRERTPERVVHARGASAKGFFEVTHDITHLTCADFLRGPGVQTPVIVRFSTVIHERGSPETIRDPRGFAVKFYTREGNFDLVGNNFPVFFIRDGMKFPDVIHAFKPNPKSHIQEYWRVLDFCSYLPESLHTFMFLFDDVGVPQDYRHMEGSSVNTYTLINKAGKVHYVKFHWKPTLGVKCLLEEEAIRVGGANHSHATQDLYDSIAAGNYPEWKLYIQTIDPDFEDRFDFDPLDGTKTWPEDLVPLQPVGRLVLNRNIDNFFAENEQLAFSPSLVVPGIYFSDDKVLQARIFAYGDTQRHRIGPNYLQLPVNAPKCAHHNNHYDGTMNFMHRDEEVDYFPSRYDTARHAEKFPIPPVNLIGRRDRRIIEKENNFKQPGDLYRTWAPDRQERFIRRWIGVLSDPKVTHEVRSIWISYLSQADRSLGQKVASHLNMRPSI

SEQ ID NO: 8797 - protein, 692 aa, Saccharomyces cerevisiae
MGNSSSKSSKKDSHSNSSSRNPRPQVSRTETSHSVKSAKSNKSSRSRRSLPSSSTTNTNSNVPDPSTPSKPNLEVNHQRHSSHTNRYHFPSSSHSHSNSQNELLTTPSSSSTKRPSTSRRSSYNTKAAADLPPSMIQMEPKSPILKTNNSSTHVSKHKSSYSSTYYENALTDDDNDDKDNDISHTKRFSRSSNSRPSSIRSGSVSRRKSDVTHEEPNNGSYSSNNQENYLVQALTRSNSHASSLHSRKSSFGSDGNTAYSTPLNSPGLSKLTDHSGEYFTSNSTSSLNHHSSRDIYPSKHISNDDDIENSSQLSNIHASMENVNDKNNNITDSKKDPNEEFNDIMQSSGNKNAPKKFKKPIDIDETIQKLLDAGYAAKRTKNVCLKNNEILQICIKAREIFLSQPSLLELSPPVKIVGDVHGQYGDLLRLFTKCGFPPSSNYLFLGDYVDRGKQSLETILLLFCYKIKYPENFFLLRGNHECANVTRVYGFYDECKRRCNIKIWKTFIDTFNTLPLAAIVAGKIFCVHGGLSPVLNSMDEIRHVVRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLDPLDSAALKQVMKKGRQERKLANQQQQMMETSITNDNESQQ

SEQ ID NO: 8798 - protein, 548 aa, Brassica rapa
MKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTDQEAALVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSEENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 8799 - protein, 361 aa, Elaeodendron orientale
QKLAVRAISQLQSLPGGDIKLLCDTVVECVRDLTGYDRVMVYKFHEDEHGEVVAESKRPDLEPYIGLHYPSTDIPQASRFLFKQNRVRIIVDCHASPVCVIQDDGLMQPLCLVGSTLRAPHGCHAQYMENMGSIASLAMAVVINGNDEEVIRGKNLTRLWGLVVCHHTSARCIPFPLRYACEFLMQAVGLQLNMELQLAAQLLEKHVLKTQTLLCDMLLRDSPIGIVTQSPSIMDLVKCDGAALYYQGNYYPLGVTPSEVQIKDIVEWLLAFHGDSTGLSTDSLADAGYPRAALLGDAVCGMAVAYITNRDFLFWFRSHTAKEIKWGGAKHHPEEKDDGQRMHPRSSFKAFLEVVKSRSLP

SEQ ID NO: 8800 - protein, 362 aa, Elaeodendron orientale
QSQKLAVRAISQLQSLPGGDIKLLCDTVVECVRDLTGYDRVMVYKFHEDEHGEVVAESKRPDLEPYIGLHYPSTDIPQASRFLFKQNRVRIIVDCHASPVCVIQDDGLMQPLCLVGSTLRAPHGCHAQYMENMGSIASLAMAVVINGNDEEVIRGKNLTRLWGLVVCHHTSARCIPFPLRYACEFLMQAVGLQLNMELQLAAQLLEKHVLKTQTLLCDMLLRDSPIGIVTQSPSIMDLVKCDGAALYYQGNYYPLGVTPSEVQIKDIVEWLLAFHGDSTGLSTDSLADAGYPRAALLGDAVCGMAVAYITNRDFLFWFRSHTAKEIKWGGAKHHPEEKDDGQRMHPRSSFKAFLEVVKSRSC

SEQ ID NO: 8801 - protein, 1307 aa, Magnaporthe grisea
MADAATLAAVAAIVENIATNSGAPGKNASFRSSTYVQLPGPESDEKKQLERELAALVIRVQQLETRANAAPATIFPDTPNETAYSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNVNVMAQNLTDQVREIASVTTAVAHGDLTQKIESAAKGEILQLQQTINTMVDQLRTFASEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 8802 - protein, 374 aa, Elaeodendron xylocarpum
ALSIAGAVQSQKLAVCAISQLQSLPGGDIKLLCDTVVESVGDLTGYDRVMVYKFHEDEHGEVVAESKRPDLEPYIGLHYPSTDIPQASRFLFKQNRVRIIVDCHASPVRVIQDGGLTQPLCLVGSTLRAPHGCHAQYMENMGSIASLAMAVVINGNDEEVIGGRNPTRLWGLVVCHHTSARCIPFPLRYACEFLMQAFGLQLNMELQLAAQLLEKHVLKTQTLLCDMLLRDSPIGIVTQSPSIMDLVKCDGAALYYQGNYYPLGVTPSEAQIKDIVEWLLAFHGDSTGLSTDSLADAGYPGAALLGDAVCGMAVAYITNRDFLFWFRSHTAKEIKWGGAKHHPEDEDDGERMHPRSSFKAFLEVVKSRSLPWEN

SEQ ID NO: 8803 - protein, 206 aa, Brassica napus
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVIGNKVDVDGGNSRVVSEKKAKAWCASKGNIPYFETSAKEGTNVEEAFECIAKNALKSGEEEELYLPDTIDVGTSNQQRSTGCEC

SEQ ID NO: 8804 - protein, 1014 aa, Unknown
  Synechocystis sp. PCC 6803
MSPSQPHPPIATFEPESFLILVVDDVKENIYVISELLEGEGYSTTFVTSGPEALQRVTQAQPDLILLDLMMPGMDGLEVCDRLKQDPQTRDIPVIFLTASNEKQDLLQAFAKGAVDYVTKPFSPPELLARVKTHLELKQTRDNLHHTLLEQARTAEALACTSTRLGILVQNMQAGVLMTDAQGTIVVVNPEFARLFNLGFPADLLLGKNLTAIAPRINGLISHGQGVTHNFLAIESPEPLLKVELALEDGRFFERDYVPIMLGDSSQGHFWLYRDISQRKQVEMIQGQSLEMERRMRQQLAEQNQELVAATTAAEAANRSKSEFLATMSHEIRTPMNAIIGMTGLLLDTDLTTQQKYFAQTIRNSGETLLTLINDILDFSKIEAGKLDLEVYPFDLGQCLEEALDVVVPSARQKSLTLIRRFLTPIPPNLQGDVTRLRQILVNLLSNAVKFTEAGQVKVTVEVVDHDAAKGEYQICFAVQDTGIGIAPNQQQALFQAFSQGNSSITRRFGGTGLGLAICVRLTALMGGTIWAESNGCVVGNPPELWQIGQPTIEGSTFYFTVNLTVLPSCAYSVHNLRHSLFIGRSVLVADYDEGRGTRMRNLLASWRLQAEQITFSSPAKLGEDLKSRLTQKNYGALILHCPYPEGRGKQFTDFDLGKITTWAPTEQDIPVLVATDIYLSPGERYSGDKPPVQAWIKSPINPDELENTLVDVLGQTEPPTLVSTEAISGPLFPYSSSNLTILLAEDNLINQQVAKLLLKKLGYPVDVVNNGQEALSALAKGDYDVVLMDVEMPEMDGLTATEHIRRSQGRSERPWIIAVTAYSMEGDRERCLASGMNDYVSKPIRLEALQQALQVAATALQSTSQDRMATVSCVSAFEAKPSPSSPCPEDPAGTTLPPIDQDIICSLRDLDRENGQLILREIIDIYCQTAPELLQRIKLAIANQDWGNLSSAAHTLGSSSANLGAVLLAQQAKTLENLTRQRDSRAMDPGHFPTLAASYERVQGELKTMLDRL

SEQ ID NO: 8805 - protein, 374 aa, Elaeodendron xylocarpum
ALSIAGAVQSQKLAVRAISQLQSLPGGDIKLLCDTVVESVRDLTSYDRVMVYKFHEDEHGEVVAESKRPDLEPYIGLHYPSTDIPQASRFLFKQNRVRIIVDCHASPVRVIQDGGLTQPLCLVGSTLRAPHGCHAQYMENMGSIASLAMAVVINGNDEEVIGGRNPTRLWGLVVCHHTSARCIPFPLRYACEFLMQAFGLQLNMELQLAAQLLEKHVLKTQTLLCDMLLRDSPIGIVTQSPSIMDLVKCDGAALYYQGNYYPLGVTPSEAQIKDIVEWLLAFHGDSTGLSTDSLADAGYPGAALLGDAVCGMAVAYITNRDFLFWFRSHTAKEIKWGGAKHHPEDKDDGERMHPRSSFKAFLEVVKSRSLPWEN

SEQ ID NO: 8806 - protein, 379 aa, Kineococcus radiotolerans
MAKLLEPLTLRGTTFANRIWASPTCQYSCDPDLAPGVPTDWHLVHLGGLAVGGCGLVLTEAAAVVPEGRITPQDAGLWNEEQTRAWTRVVDFAHSQGVAIGVQLAHAGRKASTHRPWAEQQGSVPPAEGGWETVGPSALAFGDHAVPTALDEAGLERVVTAFADAARRAETAGFDVVELHAAHGYLLHQFLSPLSNHRTDGYGGDLAGRSRLLLEVLDAVRAVWPRDKPVLVRLSTSDWVEGGWDVAESVELTRELAARGADLVDASSGGNDPRQRIPVGPGYQVPAAARIRRETGVPVAAVGLILEPAQAEQVLVSGDADAVFLARPLLADPRWPQRAAQALHAPEAVAWPPQYVRATRAPVPHVSPRQARRGADGTP

SEQ ID NO: 8807 - protein, 374 aa, Euonymus alatus
ALSIAGAVQSQKLAVRAISQLQSLPGGDIKLLCDTVVETVRDLTGYDRVMVYKFHDDEHGEVVAENKKPDLEPYIGLHYPATDIPQASRFLFKQNRVRMIVDCHASTVRVIQDDRLVQPLCLVGSTLRAPHGCHAQYMENMGSQASLALAVISNGNDEEVIGGRNATRLWGLVVCHHTSARCIPFLFRYACEFLMQAFGLQLNMELQLAAQVSEKHVLKTQTLLCDMFLRDSPTGIVTKSPSIMDLVKCDGAAFYYQGKYYPLGVTPAEAQIKDIVEWLLAFHGDSTGLSTDSLADAGYPAAASLGDSVCGMAVAYITNRDFLFWFRSHTTEEIKWGGAKHHHEDKDDGQRMHPRSSFKAFLEVVKSRSFPWEN

SEQ ID NO: 8808 - protein, 604 aa, Wolinella succinogenes
MCSICGGTIKPSLIQKASDTMRHRGPDARSFWSDGKISLAHNRLSILDLSEAGNQPFGDERYRLIFNGEIYNFQELSSDYGLRLQSSSDTEVLWRLLILEGERILPRLNGMFSFLFYDGHKGEILMARDRFGKKPLFYFHEGKELGVASEIKALRAILGEKGALDQGALLDYLSYLAPCGEKSFFPTIHKLPAGCLARFSLSEGRLEKSSFYSLPSAPSRENIEEKEALRKIEELLVESVRYRLLSDVPVASFLSGGIDSSLISALYARLSPCSIETFSIGYDEYKHYDELPYAREVASHIGSIHHEKIATRKDFLEAFEEVLPILDEPLGDPAIIPTYLLSKEVAKSGFKVVLSGEGSDEIFFGYDGYFDSLKLLWLENSLGLKEKAILLDYHRKSEHGGKEWERLRRLLMDEKPYFRGINESWTPGQRARLFKQEPAWRDPILETFQDFPSKEGEGWYSYIDLKHWMAEVLMSKMDRMSMAHSLESRAPFLDYQLVDFVLSLPSSLRTGEITKNLLKKIALAYLPDSIVNRRKKGFSSPMFEWYFEAYQGRILEDYQRVNRELGWFEDSYLKFLYEKGRMGEYKSQNWGMILFSRWFLIHCG

SEQ ID NO: 8809 - protein, 908 aa, Zea mays
  misc_feature (274)..(274): Xaa can be any naturally occurring amino acid
IRHEGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKSILRMQTMLSDMLFKESSPLSIVSGSPNIMDLVKCDGAALLYGDKVWRLQTAPTESQIRDIAFWLSEVHGDSTGLSTDRLQDAGSLVPPPPXHPGAASLGDMICGMAVAKITSKDILFWFRSHTAAEIKWGGAKHDPSDKDDNRRMHPRLSFKAFLEVVKTKSLPWSDYEMDAIHSLQLILRGTLNDASKPAQASGLDNQIGDLKLDGLAELQAVTSEMVRLMETATVPILAVDGNGLVNGWNQKVAELSGLRVDEAIGRHILTLVEDSSVPIVQRMLYLALQGREEKEVRFELKTHGSKRDDGPVILVVNACASRDMHDHVVGVCFVAQDMTVHKLVMDKFTRVEGDYRAIIHNPNPLIPPIFGADQFGWCSEWNAAMTKLTGWHRDEVIDRMLLGEVFDSSNASCLLKSKDAFVRLCIIINSALAGEEAEKAPIGFFDRDGKYIECLLSVNRKVNADGVVTGVFCFIHVPSDDLQHALHVQQASEQTALRRLKAFSYMRHAIDKPLSGMLYSRETLKGTGLDEEQMRQVRVADNCHRQLNKILADLDQDNITDKSSCLDLDMAEFVLQDVVVSAVSQVLIGCQGKGIRVACNLPERSMKQKVYGDGIRLQQILSDFLFVSVKFSPAGGSVDISSKLTKNSIGENLHLIDFELRIKHQGAGVPAEILSQMYGEDNREQSEEGLSLLVSRNLLRLMNGDIRHLREAGMSTFILTAELAAAPSAAGH

SEQ ID NO: 8810 - protein, 294 aa, Unknown
  uncultured proteobacterium
MSDTKLNTLEQPEVMAFFDAQTNTISYIVKDPSSTACAVIDSVMNMDYAAGRITFESADEIVKTIKDQGLELQWIVETHVHADHLSAAPYLQEQLGGKIGISEKIIQVQDTFGKIFNEGTAFQRDGSQFDALFEDGDSYHVGQMQATVIATPGHTPACMVHVMGDAAFVGDTLFMPDGGSARADFPGGDAGILYDSIQKVLSLPDETRLFMCHDYGPNGRDIQWETTVAEERAFNIHVGGDATRESFVKMRTERDATLAMPKLIIPALQVNMRAGEVPTDEDGHPSLKVPINSL

SEQ ID NO: 8811 - protein, 571 aa, Aspergillus nidulans
MCGIFACHHHPDVQAFKPTALRMAKAVRHRGPDWSGSFIADKTILCHERLCIVGVDSGAQPLVNDDESLALAVNGEIYNHRIVRKTLDVEYNYKTHSDCEVIIPLYMKYGLDAPKHLDGMFAWVLYDKKEDRVIAARDPIGICSFYIGWSSQTPGAVYFASELKSLHPVCDKVEAFPPGHVFDSKSGEFSRYFQPSWWDPTNVPSTPVDYKAIRESLTRSVRKRLMAEVPYGVLLSGGLDSSLVASIAQRETLRMQKASSGVKSEANGELVGIDDENELSTVNSFQQLQSFSIGLPGAPDTEAAMEVAKFLGTKHHALTFTIEDGLNALSDVIYHLETYDVTTIRASTPMYLLSRKIKGLGVKMVLSGEGSDEIFGGYLYFHAAPNKEEFHKETVRRVKNLHLADCLRANKSTSAWGLEARVPFLDKAFIETSMSVDPQEKMITKDRIEKYILRKAFDTSDEPDVEPYLPDKILWRQKEQFSDGVGYSWIDGLKDHAELHVTDEMMKNPKPEWGDDIPTTKEAYWYRMMFDEHFPSYCASTVERWVPTWSKQSDPSGRAIATHNAKYDDAE

SEQ ID NO: 8812 - protein, 545 aa, Borrelia garinii
MAKDIYFNEDARKSLLSGVEKLSNAVKVTLGPKGRNVLIDKKFGSPTVTKDGVSVAREIELENPFENMGAQLLKEVAIKTNDVAGDGTTTATVLAYAIAREGLKNVSSGINPIGIKKGIDHAVNLAAEKIRQSAKKITTKEEIAQVASISANNDSYIGEKIAEAMDKVGKDGVITVEESKTFDTTISYVEGMQFDRGYLSPYFSTNKENMSVSFDDAFILIYEKKISSIKELLPVLEKVLGTNKPLLIIAEDIEGDALAALVLNSVRGALKVCAIKSPGFGDRRKAMLEDIAVLTGGVLISEELGITLETVEIEQLGQAKTIKVDKDNTTIINTGNKEQIKERSELIKKQIEDSTSEYDKEKLQERLAKLVGGVAVINVGAVTEVELKEKKHRVEDALSATRAAVEEGVVPGGGSTLIEVAMYLDTIDTSKLSYEEKQGFEIVKRSLEEPMRQIISNAGFEGSIYIHQIKTEKKGLGFDASSFKWVNMIESGIIDPAKVTRSALQNAASIAGLLLTTECAITDIKEEKNTSGGGGYPMDPGMGMM

SEQ ID NO: 8813 - protein, 479 aa, Agrobacterium tumefaciens; identical to SEQ ID NO: 101

SEQ ID NO: 8814 - protein, 539 aa, Streptococcus thermophilus
MAKDIKFSSDARAAMVRGVDTLADTVKVTLGPKGRNVVLEKAFGSPLITNDGVTIAKEIELEDHFENMGAKLVSEVASKTNDIAGDGTTTATVLTQAIVREGLKNVTAGANPIGIRRGIEAAVAAAVEELKVIAQPVANKEAIAQVAAVSSRSEKVGEYISEAMERVGNDGVITIEESRGMETELEVVEGMQFDRGYLSQYMVTDNEKMVADLENPYILVTDKKISNIQDILPLLEEVLKTSRPLLIIADDVAGEALPTLVLNKIRGTFNVVAVKAPGFGDRRKAMLEDIAVLTGATVITEDLGLELKDATMESLGQASKVTVDKDSTVIVEGAGSAEAIANRVNLIKSQLETTTSEFDREKLQERLAKLSGGVAVIKVGAATETALKEMKLRIEDALNATRAAVEEGIVAGGGTALVNVIAKVAELDLEGDDATGRNIVLRALEEPVRQIAYNAGYEGSVIIDKLKNSPVGTGFNAANGEWVDMVESGIIDPVKVTRSALQNAASVASLILTTEAVVADKPEQKAPAAPATDPGMMGY

SEQ ID NO: 8815 - protein, 492 aa, Soldanella alpina
MDPYKYRSSSAFNTPFWTTNSGAPVWNNNSSLTVGTRGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFTFLFDDLGVPQDYRHMEGSGVNTYTLINKAGKAQYVKFHWKPTCGVKCLLEDEAIKVGGANHSHATKDLYDSISAGNYPEWKLFIQIIEPDHEDKFDFDPLDVTKTWPEDIIPLMPVGRLVLNKNIDNFFAENEQLAFCPALIVPGVYYSDDKLLQTRIFSYADTQRHRLGPNYLQLPPNAPKCAHHNNHHEGLMNFMHRDEEVNYFPSRFDPVRHAERHPIPPPVLTGKRDRCMIEKENNFKQPGERYRTFAPDRQERFVCRWVDALSDPRVTHEIRSIWISYWTQADKSLGQKLASRLNVRPTM

SEQ ID NO: 8816 - protein, 594 aa, Salmonella enterica
MSSKIFCKSWGAEYIAADVVRFRLWATGQQKVMLRLAGKDQEMQVSGDGWFTLDVSGVTPGTEYNFVLSDGMVVPDPASRAQKTDVNGPSYVVDPGSYAWRNTGWKGSRWEQAVVYEMHTGTFTPEGTFRAAIAKLPYLAELGVTVIEVMPVAQFGGERGWGYDGVLLYAPHSAYGTPDDFKAFIDAAHGYGLSVVLDIVLNHFGPEGNYLPLLAPAFFHKERMTPWGNGIAYDVDAVRRYIIEAPLYWLTEYHLDGLRFDAIDQIEDSSARHVLVEIAQRIREDITDRPIHLTTEDSRNIISLHPRDQDGNAPLFTAEWNDDFHNAVHVFATGETQAYYNDFADAPEKHLARALAEGFAYQGEISPQTGEPRGVKSTGQPPVAFVDFIQNHDQVGNRAQGDRLITLAGAERTKVLLATLLLSPHIPLLFMGEEYGESRPFLFFTDFHGDLARAVREGRAKEFADHAGENVPDPNAPETFQRSKLNWKQQHSEEGKAWLAFTRELLLLRQKHIVPLLSAARESSGTVLQTAPGFIAVSWRFPGGTLSLALNISATTVLLPDLPGKTLFAWPNESTGSLSQHSLIVRLAQGESAS

SEQ ID NO: 8817 - protein, 606 aa, Wolinella succinogenes
MCGILGYLRKGSAGQSQLSCEQFNQILSKIAHRGPDHQDFVWFNEPEYQLYLGHVRLSIIDLDERASQPMLFKDRYLLVFNGEIYNYRELKEKLLLQGYGFATQSDSEVLLAAYDFWGETCVEHFNGMWAFAIYDKKRHSLFCSRDRFGVKPFYFYENEEIFVFASEIKALLPFFKEAKLNPKVILPYLARGFLDGGSETFFDGVYRLEASSNLFYDLRGKQKSFQTYYSILLNPLSAKEREIPSSAKELLSLLRQSVSLRLRSDVRVGACLSGGLDSSGVAALASQQYDFGEKLVAIHAKSSLKESDESSYAIEVANHLGLDLHMVEPSFEDFCESLDDLFYTQEEPFGSTSMFMQYFVMKKAKELGCKVMLDGQGADEVFLGYEHYFHNIFKDLRDRKFFLENDFFKDLKTFRYTKEQILEELKKADDAGVAWDVIKNRGNICSRYLCREWLDSYIAPVKTIQEFQKREIFYNHLPSLLRYEDRDSMRFGIETRLPYLDYRIVEWVLALPTEVKFQQGYLKFALREALEISGLLPKSIVWRYNKMGFESPQKLWIDRYRFEMMKVIEGSEIIRDIFFKVDIRRDDFLWKLFSIAKWEKMFNVKL

SEQ ID NO: 8818 - protein, 396 aa, Rhodopirellula baltica
MCHPREAFVYRDAFGGLRESFFLSTFDTICCGMIGETAGADRVNSLCRELIPGFMMTTEAATIPVRPSQANLEADVLSPIQPDTPTSSYPDAGASSYSDPTKRSIRWDYTIFFVSLHLLTLLVLLPYFFSWAGVAAFVVGVIVFGQMAIPIGYHRMLSHRSFRSPKWFERTLVTLAMCTAQETPAHWVAWHRMHHSHSDHAEDPHSPRISFMWAHVRWLVHESRTRMATFSMYEKYARDILSDPYYRWIEKLPSPAGMFYLAHAFVYALLAVGISGLVYGNNADAYQMAASVFVWGVIARTVWVWHITWSVNSITHVFGYRNYQTTDDSRNNWFVSLLTAGEGWHNNHHADPASASVQHRWWEIDPNYYVIRLFGVLGLATHIIRPRHVRKSGAES

SEQ ID NO: 8819 - protein, 275 aa, Arabidopsis thaliana
IKSFHLQLSYGCEKTTEGAAIKQFLHCNSQATFKLKLERQEILRIFNLMALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 8820 - protein, 173 aa, Pseudomonas syringae
MSLHELNTLPGVTANPEAATRQFVFNHTMLRVKDITKSLDFYTRVLGFSLVEKRDFPEAEFSLYFLALVDKAQIPEDDAARNEWMKSIAGILELTHNHGTESDDTASYHNGNSDPRGFGHICVSVPDVKVACERFESLGVDFQKRLSDGRMNSLAFIKDPDGYWVEIIQPTPL

SEQ ID NO: 8821 - protein, 374 aa, Euonymus europaeus
ALSIAGAVQSQKLAVRAISQLQSLPGGDIKLLCDTVVESVRDLTGYDRVMVYKFHDDEHGEVVAESKRPDLEPYFGLHYPATDIPQASRFLFKQNRVRMIVDCHASPVCVIQDYRLIQPLCLVGSTLRAPQGGHAQYMENMGSKASLAMPVIINGNDEEVIGGRNATRLWGLVVCHHTSARCTPFPLRYACEFLLQAFGLQLNMELQLAAQLSEKHVLKTQTLLCDMLLRDSPTGIVTKSPSIMDLVKCDGAALYYQGKYYPLGVTPAQAQMKDIVEWLLAFHGDSTGLSTDSLADAGYPGAALLGDAVCGMAVAYITKRDFLFWFRSHTAKEIKWGGAKHHPEDKDDGQRMHPRSSFKAFLEVVKSKSLPWEN

SEQ ID NO: 8822 - protein, 278 aa, Unknown
  Shewanella sp. MR-7
WASDHRVHHKHVDDNDKDPYSAKMGFWYSHIGWMLREYQAQRYHDYQNVRDLQNDRIVMWQHKHYLALVILMNIGLPALLGWFTGNIAGMLLMAGLLRLVVVHHCTFFINSLAHVWGNQPYTDKNTARDNGFLAMLTYGEGYHNFHHIFENDYRNGIKWWHYDPTKWLIKALSWVGLATDLRTSPQERIESARLQMQLLHAKNKVIHLPNADEIIEKIQQEYELMKEHLLEYYQAKKALLEAKRKQLVDQQLLLQVEELKTRFLTQQKSWKSLTASYS

SEQ ID NO: 8823 - protein, 593 aa, Unknown
  Frankia sp. EAN1pec
MCGLSGELRFDGREADVAAVGRMTAAMEARGPDGVGLWATGPVAFGHRRLKIIDLSERGAQPMVDTALGLTAVFNGCIYNYQELRDRLVDAGYRFFSTSDTEVILKAYHHWGPRCVDHFAGMFAFAVYERDTGRLVLVRDRLGIKPLYVTRDPHRLRFASTLPALLAGGGVSSDIDLVAFHHYLSFHSVVPPPHTILTGVRKLPQATIRTVEADGTTRDEVYWRPDSTRQEEHASWTADDWRDAIGERLRTAVRRRMVADVPVGVLLSGGLDSSLIVALLAEAGQRDLATFSVGFEAAGGESGDEFHYSDIIARRFGTDHHQIRVPGDRLLPAIDAAVAAMSEPMVSHDCVAFYLLSQEVARHVKVVQSGQGADEVFAGYSWYPPLATVPRGDAVDAYLRVFADRPHAELPAMVESHHLIEGDASRHFVAERFAEPGAETSVDAALRIDSTVMLVDDPVKRVDNMTMAAGLEARTPFLDHELVELAAACPPELKLASGGKGVLKDLSRPLMPVDVIDRPKGYFPVPAIRHLGGPFLARVADALTDPVARGRGLFRKDWVDEMLADPNSNRTTLGANALWQAALLEMWLQTQGV

SEQ ID NO: 8824 - protein, 374 aa, Euonymus europaeus
ALSIAGAVQSQKLAVRAISRLQSLPGGDIKLLCDTVVESVRDLTGYDRVMVYKFHDDEHGEVVAESKRHDLEPYFGLHYPATDIPQASGFLFKQNRVRMIVDCHASPVRVIQDDRLIQPLCLVGSTLRAPHGCHAQYMENMGSKASLAMAVIINGNDEEVIGGRNATRLWGLVVCHHTSARCTPFPLRYACEFLLQAFGLQLNMELQLAAQLSEKHVLKTQTLLCDMLLRDSPTGIVTKSPSIMDLVKCDGAALYYQGKYYPLGVTPAEAQIKDIVEWLLAFHGDSTGLSTDSLADAGYPGAASLGDSVCGMAVAYITNRDFLFWFRSHTTEEIKWGGAKHHPEDKDDGQRMHPRSSFQAFLEVVKSRSFPWEN

SEQ ID NO: 8825 - protein, 475 aa, Gibberella zeae
MATATAAGKNASPFPDGTKDYVPLRAGAAKKDTNKPHISDTPMTWSNWPQHINWLNTTLVVFVPLMGFISAYWVPLQLKTALWAVFYYVHTGLGITAGYHRMWSHSAYKGTTPLKIYLAAVGAGAVQGSIRWWSYGHRVHHRYTDTDKDPYSVRKGLMYSHMGWMVLKQNPKRQGRTDITDLNEDAVVVWQHKNYIKCVLFMALAFPAIVAGLGWGDWWGGLVYAGILRVCFVQQATFCVNSLAHWLGDQPFDDRNSPRDHVITALVTLGEGYHNFHHEFPSDYRNAIEWWQYDPTKWSIWLWKQLGLAYELKEFRANEIEKGRVQQLQKKLDQKRATLDWGIPLEQLPVVDWDDFVAQSKAGKGLVAIAGVIHDVTDFIKDHPGGKALINSAIGKDATAIFNGGVYLHSNAAHNLLSTMRVGVLRGGCEVEIWKRAQFENKDITYMNDSAGQRIIRAGSQATKIVQPAASADAA

SEQ ID NO: 8826 - protein, 374 aa, Gyminda tonduzii
ALSIAGAVQSQKLAIRAISQLQSLPGGDIKLLCDTVVESVRELTGYDRVMVYKFHEDEHGEVAAESKRTDLEPYFGLHYPATDIPQASRFLFRQNRVRMIVDCHASPVRVIQDDGLMQPLCLVGSTLRAPHGCHAQYMENMGSKASLAMAVIINGNDEEVIGGRNATRLWGLVVCHHTSARCIPFPLRYACEFPMQAFGLQLNMELQLAAQLSEKHVLKTQALLCDMLLRDSPTGIVTQSPSIMDLVKCDGAALYYQGKYFPIGVTPTEAQIKDIVEWLLVFHGDSTGLSTDSLADAGYPGAALLGDAVCGMAVAYITKKDFLFWFRSHTTKEIKWGGAKHHPEDKDDGQRMHPRSSFKAFLEVVKSRSLPWES

SEQ ID NO: 8827 - protein, 403 aa, Clostridium acetobutylicum
MDNKKKKWIVITVAIVVVTNIASLFLGGRFLVFAGNSRVAVDKDTYDTVQKFSKLFSVRDQLYKYYDGKISDSVLLDGALKGMTSSLKDPYTVYMDKSETKSFNSEIQGQQYVGLGMEVQAKDNKVIVSTVFDNSPAEKAGMKSGDVIVKVNGTDAVSTDLEKTVSMIKGKEGTSVTLTLYRSTKGNFDITAKRQKVAIDTVSGEMLSNEIGYMQVSMFDENTGNNFNKKIDELKQQGMKGLILDLRSNPGGLLSACIQVTSNFVTKDKVIVSTIDKYNSKEEYKSKGGNYIGLPLVVLVDGNTASASEIFSGAIRDYKLGTLIGEKTFGKGVVQAPFDLNDGTQLKITISKYYTPNGENIHHKGIKPDIEVKYPDTLKDKPYDRNSDPQFQKALEQIKSKMK

SEQ ID NO: 8828 - protein, 449 aa, Idiomarina loihiensis
MNTKQQLVFIMADYRLGLFVFRNDLRVEDNLALYEAAQRSETLICCFCFNPTQNKYGHYGIPAMGKHRFTFLQQSLKQLRTELEMRGQKLIVLTGTFDRILTELISERQVDAIFLSQHQGYYERLQLGLLQQRFPFLPFHETPNNTLFSEQELPFELADLPETFSQFRKKVEPLSRNFSVQPVNALPSLPKNISYPGFKAETLNELASDDFEGGERAALTHLTSYFSGESAGTYKQTRNALDDFSSSTKFSPWLAQGCLSVRQIMAALRAYETEFGENESSYWISFELLWREYFFWYALKHGKRLFAFSGLSGKSPKTSFYSERFQKWCSGNTPYPIVNACMKQLNATGYMSNRGRQLVASCFVHELSLDWRYGAAYFEQQLIDYDVSSNWGNWQYLAGVGADPRGHRQFNLEKQTERYDPDNEFIERWAGDLSGQPIDSVDAADWPVR

SEQ ID NO: 8829 - protein, 245 aa, Gymnosporia mossambicensis
ALSIAGAVQSQKPAVRAISQLQSLPGGDIKLLCDTVVESVRNLTGYDRVMVYKFHEDEHGEVVAESKRSDLEPYIGLHYPASDIPQASRFLFKQNRVRMIVDCHASPVRVIQDDGLMQPLCLVGSTLRAPHGCHAQYMENMGSLASLAMAVIINGNEEEAIGGRSPTRLWGLVVCHHTSARCIPFPLRYACEFLMQAFGLQLNMELQLAAQLLEKHVLKTQTLLCDMLLRDSPTGIVTQSPSIMD

SEQ ID NO: 8830 - protein, 798 aa, Aspergillus nidulans
MSSQGITRKRPAPGTSPAVHPQLGQLPNYPPTSGSPLSNDQFLQWGQNPSPNTVAPGSFPDANTYNTGALPASAHDISGVSTANNQVARRTPSTQIVNRSRSYEQPPAPLSDPSNVPSEPGGWSESLEELYKRALAAKREAQAKRKQIPPFVQKLSSFLDESKNTDLIRWSDDGNSFIVLDEDEFAKTLIPELFKHNNYASFVRQLNMYGFHKKVGLSDNSMRASERKNKSPSEYANPYFKRGHPDLLWLIQKPKNTAGQGTKSGKGYVRVKTEDAENENEDFGDENAGASRDDGARNRQLSLVAQQPSLPKDQFATVYRELQAIRQQQQIISSTINKLRREHEQLYAQAANFQEQHTRHENSINAILTFLATVYNRSLQGQEGQNLANSFAGAISQDQGNVVDMGDGYSFGPLGAPSMNSPGGPRSMKKQPLLLKAPPGSERHGRAATLSPAATAYDRSQSRNNSRQTSTSQSGQVEEVFDNNSPRSKETSSSQAQQYPQRDIMSVIQNANARNGIPTSYSDFPNVLSSLETSNGNVPLTSNQRADMLRLMANESGTNDSGVTVSQNNALISPVPPPMPNNYSARLADTRSEIDNLMKMQAEQDRSVQNLTNLLQPLSPSGTIPGIGSDGTIPPPPLELDQIFNNDYFTDFGDYDQQNRANVDLGDSTGAGQAPPSTEPPAPPDDIAIKHDGNDLFDFDHLAGEGELFAGTNNQSSPGYFPQFDSGYGHSAANTTGASTGVSGSGRVVETLTDSESTSPSNTVDDPTHYSADVFDAGDGSQGGKSSSGGGSKRRRKA

SEQ ID NO: 8831 - protein, 189 aa, Unknown
  Polaromonas sp. JS666
MLQRVRSSPNMTPLRGKAARWPPPASRPGVMAARAILSSMRPWRKSTRRGYMHNRLRMVTASFLVKDLGIDWRWGERYFAEKLNDFDLSANNGGWQWAASTGCDAQPYFRIFNPVSQSEKFDAEGKFIRKYLPPLEKLPASCLHSPWLAKPVELSAAGVSLGQNYPMPIVQHDEARALTLQRYAVVKKS

SEQ ID NO: 8832 - protein, 207 aa, Dahlstedtia pinnata
VMAYKFHEDDHGEVIAEITKPGLEPYLGLHYPATDIPQAARFLFMKNKVRMIVDCHAKHVKVLQDEKTPFDLTLCGSTLRAPHSCHLQYMANMDSIASLVMAVVVNDNEEDGDSSDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 8833 - protein, 245 aa, Gymnosporia mossambicensis
ALSIAGAVQSQKLAVRAISQLQSLPGGDIKLLCDTVVESIRNLTGYDRVMVYKFHEDEHGEVVAESKRSDLEPYIGLHYPASDIPQASRFLFKQNRVRMIVDCHASPVRVIQDDGLMQPLCLVGSTLRAPHGCHAQYMENMGSLASLAMAVIINGNEEEAIGGRSPTRLWGLVVCHHTSARCIPFPLRYACEFLMQAFGLQLNMELQLAAQLLEKHVLKTQTLLCDMLLRDSPTGIVTQSPSIMD

SEQ ID NO: 8834 - protein, 423 aa, Debaryomyces hansenii
MSGVQVAALKDTDLFKSLKVGEHTLSNKVVYPPTTRMRALSDHTPSDLELEYYEERSKYSGSLLIAEATFVSEQAGLNGTVPSTWNSEAAGYVPGIWNDKHAQAWKKITDRVHENGSFMSSQFWFLGRVGDPQLLKDRGLDYVAPSAIYPDEDFKKKALAAGNPIRALTEDEIHDLIYKTYPNAARKAIAAGFDYIELHAAHGYLLDQFLQPTSNQRTDKYGGSIENRARVVLELVDHLTTVVGAKKLAIRISPWATFQGMKADQDSTHAVTTFSYLLHELQKRADDGNELAYVSIVEPRVQGGDDVEKSQQVGDNTFVGQIWKGIILKSGNYTYDAPDFKTLLHDISDNRTMVGFSRYYTSNPDLVKRLYEGWDLTPYDRLTFYGSSNWGYNTFDNYNRKRQFTKDIESGKLPKAIEEIEVK

SEQ ID NO: 8835 - protein, 512 aa, Shewanella oneidensis
MSVNQNRSGKHALMWFRQDLRLTDNQAFTAACDWVRQHHAAKLKAIYIATPSQWHQHDIAPIQLDFIQRHVNLLAQGLVSLGVEFELIQLDSFRDIPAFLTSYCEEHSIGRVFAGQEPEINEQKRDQACVEAGIPLSLSDEHCLLPPGTVLNLSGDMYRVFTPFSRKWREVAAKQAILPLGVPAPLGSILSEPKPLFFKNIGSTYLAASKDIASSKKGFNQTAPNPLISSEQWAAGEGQAKRLLNQFIQQKVQDYKQDRDFPAIDGTSVISPYLAIGVLSPRQCVAALLQRFPEVIVDDTSPGRTWLNELIWREFYRHLLVAFPDLSKGNNFNRQADHVLWRNNQSEFLAWCEGKTGYPIVDAAMRQLNQTGWMHNRLRMVVASFLTKHLLIDWRWGERYFRQHLIDGDLAANNGGWQWSAGCGCDAQPYFRIFNPMSQSEKFDPDGRFIRKYLPELASWGVTRLHQPNQQKMPSLFEAPLFASQADYPNAIVEHNAARARALTVLGVLKKA

SEQ ID NO: 8836 - protein, 418 aa, Unknown
  Mesorhizobium sp. BNC1
MRNTSQASIDPATPLLFSPLSLRSVHLKNRIVVAPMCQYRSVAGGPTDWHLVHLGKFAVGGAGIVFTEETAVEERGRKTYACAGLYNDDHVKSYRRITDFIRSQGAVPAVQLGHAGRQASCHGAELGWKPLTEEDARAGLPPWQGVAPSPFAWCPDASVPHELSHADIKDMLAIWKESTLRAVDSGFDICEIHGGHGYLLHQFLSPLANKRTDAYGGDRSGRMRFVLEVTEAVRSAWPADKPLFFRMSVVDGRGGQWFVEDSIALAAELREIGVDLIDCSSGGMNGDGVFPPVPRVPEFQVEYSKALRHGARMPTLAVGLITSPRRAEAILQAGEADLIAIARGAIWDPNWPAHAAAELGKHEPYAVLPGDMAFRLRDRDSHRDSYPYGTKVDIPLSPDRSIPYSWPERGEYWPPVRE

SEQ ID NO: 8837 - protein, 408 aa, Pseudomonas fluorescens
MPGLFFSLSRALSPMWYEGLLGLSAWQLVAVTLLMTHVTIVAVTVYLHRYSAHRSLELNAGLKHFFRFWLWLTTAQNTREWTAIHRKHHAKCETADDPHSPVVKGLSTVLRKGAELYREEAKNPETLRIYGKNCPEDWIERNLYSRYKLGGVALMAAIDLLLFGTIGITIWAIQMMWIPFWAAGVINGLGHAVGYRNFECRDAATNLVPWGIIVGGEELHNNHHTYPNSAKLSVKKWEFDLGWAWIKVFSFLRLARVQRVAPIAHRVEGKGHLDMDTAMAILNNRFQIMAQYRKLVIGPLVKQELAKVDHSVRHQFHRAKRLLSRETSLLEDRHHLRIQSMLEHSQALKVIYEKRLALQQIWVKTSSNGHDMLAAIKDWVHEAEASGIQSLRDFAHQLKTYSLRPTTA

SEQ ID NO: 8838 - protein, 446 aa, Striga hermonthica
MGRMMMIEQEGRGQSVSLSRIAVSDTHGEDSPYFAGWKAYDEDPYDESLNPFGVIQMGLAENQVSFDLVEQYLEKHSDATNIGANSGFRENALFQDYHGLLSFRQAMASFMERIRGGRANFDPERIVITAGATAASELLTFILADPGDAVPVPTPYYPGFDRDLRWRTGVNIIPVHCHSANNFAITPEALDSALKHARASNTNVRALLITNPSNPLGATLSRATLDLALDFVSRHDLHLVSDEIYSGSAFSPDEFVSVSQVLESRGYKDAERVHVVYSLSKDLGLPGFRVGTIYSYNDRVVQTARRMSSFTLISSQTQKLLASMLSDKEFTEKYVRINRERLRGRYEATVEGLKRAGIRCLGGNAGLFCWMDLSGELREGSREDELELWGKLLREVKVNVSPGSSCHCSEAGWFRVCFANMSERTLEVALGRIQAFMERRRRRIAN

SEQ ID NO: 8839 - protein, 546 aa, Unknown
  Neorickettsia sp. SF agent
MANEVISGEQLQKVIRDAADLVVSSAGVTLGPEGRPVIMSKSYGGPEVTKDGYKVINQLKPEDDKVAKIVELLNQATSQANEKAGDGTTTATILVGNMIKNAHKHIAAQRSRMKLKSGMKRARDEVVKYIQSVARKINSEEEIAQVGSISANGNSEIGNKIAEAMSKVGKEGVITVEEGKGLDEFSVSVVQGMVFDRGYVSPYFITNPEKMIVEFDNPYILLANKKLSSIQPMVPLLETIVRSNRAVVIIAEDVEGEALTSLVLSKMRGSLKACAVKAPGFGDRRSEMLEDIRILTGAKTLVSDDLGVTVESLTVEDLGTAKSIIISKDSTTIVDGGGEKAAIEARVKQIKTQIDKTTSDYDKEKLQERLAKLAGGVAVLKVGGATEVEVKERKDRVEDALHATRAAVEEGIVPGGGATLLSAIAVLEKLSSDDDDEQAGINIVKAALKAPISQIVENAGEDASVIIYNLLESKDPNRIFDARELKYVDAFKAGIIDPAKVVRVALESAVSVASVLVTTEALIVDLPSKDNGSSSMMPGGGMGGMG

SEQ ID NO: 8840 - protein, 494 aa, Zea mays
  misc_feature (211)..(211): Xaa can be any naturally occurring amino acid
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILXGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENATVLKQGLEKTGKFNIVSKDNGVPLVAFSLKDNSRHNEFEISDFLRRFGWIVPAYTMPPDAQHVTVLRVVIREDFSRTLAERLVLDIEKVLHELDALPARVPSGDLAALAAAESSEREMEKKRQVISLWKRAVLAKKKTNGVC

SEQ ID NO: 8841 - protein, 424 aa, Striga hermonthica
LSTDMIEEWIDKNPKASITTREGVHAFRNIALYQDYHGLPEFRNGVAKFMSKARGGRVSFDPDRIVMGGGATGASELLMFCLADSGDGFLVPSPYYPGFDRDLRWRTGVQLLPVMCQSSNNFKITKEALEEAFDQAQKANIKVKGLMIANPSNPLGTTLDRPTLKSLVTFINERQIHLVCDEIYAATAFRAPEFISISEVIEEVECNRDLIHIVYSLSKDMGLPGFRVGIMYSYNDVVVDRGRKMSSFGLVSSQTQHLLATMLSDEEFTDKFMLENTRRLANRHEMFTKGLEEVGITCLESNAGLFCWMDLRHLLKEPTFEGEMGLWRVIITEVKLNVSPGMPFHCHEPGWFRVCFANMDDETLKVALTRIRVFVAKGSEVDAKVKKPWQMNLRLSFSSRIYDETMASSPRVMSPHSPLVRAWT

SEQ ID NO: 8842 - protein, 485 aa, Lycopersicon esculentum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEQKQQWKKNNLRLSFSKRMYDESVLSPLSSPIPPSPLVR

SEQ ID NO: 8843 - protein, 633 aa, Lactobacillus plantarum
MCGLVGCLTDRRKVDNAAYDQVVREMTKMIVHRGPDDEGYFADDNITMGFRRLSIIDLAGGHQPLSYDNERYWLTFNGEIYNYVELREQLIQEGYTFKTDSDSEVILGMYAKYQAKLTTYLRGMFAFVIWDKQEKTLFAARDQFGIKPFYYAIAGDDFYYASESKAIYKILKDKHFDQEALQDYLTFQYVPETETLTKEIKMLAPGCSLTKQLGHAPQIKRYYHWEFHPVVRSEQDYATRLKETLIDSVKIHMRSDVPVGTFLSGGIDSSIVVAIAKQFNPNLKTISVGFERPGYSELDVAQETAAKLNVDNVQMTITPEAFMAAFPHFVWSMDDPLADPAAVPQYFLTKEAVKHVKVCLTGEGADELFGGYTIYHEPESLKAFRYTKPINGALQRIAAMMPAGMRGRSLLMRGTTPLEKRYVGNAFIFNETEKQQFMKHYNRDHSFQQTTRVFYDEAKHYDLISKMQFIDMHTWLNGDLLHNADRTALAHSLELRTPFVDREVFNLAAEIPANLRISHGTTKYILRKAVEDIVPAHVLYRKKLGFPVPIRLWLKDEMYDWAKNIIVTSQTDQYFDKTYFLKLLDDHRAGIRDNSRQLWTVLTFMMWHKLYVEADMLMDSVTANHLAEQVEIG

SEQ ID NO: 8844 - protein, 463 aa, Arabidopsis thaliana
MAEEGFIGIGESEEEAAEIGAFSYSHHQISDLRRRSSAVKDDSAQTSTPSSPPPPLPIHAGGSAVGATGKAKKKTGGARLWMRFDRTGAMEVVECDKSTIIKRASVPARDLRILGPVFSHSSNILGKNFDLLIPGLAREKAIVVNLEVIKAIVTAEEVLLLDPLRPEVLPFVERLKQQFPQRNGNENALQASANVQSPLDPEAAEGLQSELPFEFQVLEIALEVVCSFVDKSVAALETEAWPVLDELTKNVSTENLEYVRSLKSNLTRLLARVQKVRDELEHLLDDNEDMADLYLTRKWIQNQQTEAILAGTASNSIALPAHNTSNLHRLTSNRSASMVTSNTEEDDVEDLEMLLEAYFMQLDGMRNKILTVREYIDDTEDYVNIQLDNQRNELIQLQLTLTIASFAIAAETLLASLFGMNIPCPLYSIHGVFGYFVWSVTALCIVLFMVTLGYARWKKLLGS

SEQ ID NO: 8845 - protein, 165 aa, Magnaporthe grisea
MSDSPQSNPKEIEGAHTPDEEAQMNDPQDPQSAGLGYEFEVKEQDRWLPIANASEKCHQEKRKTVNGEDILFAMTSLGFENYSEALKIYLAKYREQNQSTRGEGQQNRPSSQGYGAPPGAAPGTNATAGFPGGELGQQGTEAPGDASGYLYSTQPGHNGATAGEY

SEQ ID NO: 8846 - protein, 637 aa, Oceanobacillus iheyensis
MYHISAEDIYLFHQGTNFESHQFLGCHEINWKGKRGYRFAVWAPNALKVCVVGDFNNWEENSHPLEKFTDEGLWGGFIADIPPATSYKYHICSSEDTSILKADPFATQAERRPKTASVIPAANGYQWSDDQWIEQRNTYDPYSSPISIYEVHLGTWKKTLKKQFLSYRELATQLIPYVKSLGYTHIELLPINEHPFDRSWGYQITGYFAVTSRYGNPSDFKYFIDQCHQHQIGVILDWVPGHFCKDDFGLRQFDGAPLYEYRDPKKSEKKSWGTLAFDYGRPEVQSFLISNAIYWLKEFHIDGLRVDAVASMLYLNFDRYDEEEKIYNTYGGEENLEAFAFLRKLNKVVFSYIPGALMMAEDSSDLPLVTAPVNKGGLGFNYKWNMGWMNDLLSFMEKESIHRKWHHNRLTFSFMYTYSENYLLPLSHDEVVHGKKSLLDKMPGDQWQQFANLRLLYGYMYTHPGKKLVFMGGELAQYAEWKDTEELDWHLLEYPLHKGIYHYIKNLNELYQQHPELYELDHLSEGFEWIDPHNIDQSVIAFRRKANKPNQELIIICNFTPQVHFDYKIGVPESGRYKEIFNSDSVRFGGSGQINEGEHFSFPEKWHGLSQHIKIKVPPLAISVFQIEVERERLPRE

SEQ ID NO: 8847 - protein, 172 aa, Oryza sativa
GFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 8848 - protein, 519 aa, Lycopersicon esculentum
QGELFLKTRAEELDKEMGLIIRQEETGRHVRMLTHEIRSTLDRHTTLKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 8849 - protein, 200 aa, Xeroderris stuhlmannii
HEDDHGEVIAEVKKPGLEPYLGLHYPATDIPQATRFLFMKNKVRMIVDCRAKHVNVLQDKKVPFDLTLCGSTLRAPHSCHLQYMENMNCSASLVMAVVVNDNDEDGDSDAVQPQKRKRLWGLVVCHNTTPRFVPFPLRYACEFLAQVFAIHVNKELELEYQIVEKNILRTQTLLCDMLMRDAPLGIVTQRPNIMDLVKCD

SEQ ID NO: 8850 - protein, 370 aa, Corynebacterium glutamicum
MDFWTILDTMTSLLTPIAIRGLEIPNRMWLAPMCQYQANNLDGVPLDWHLVHYGARAVGGFGLLIAESTGISPEGRISSRCTGLWNEAQVEAWERITNFVHAQGGLIGVQLNHAGRKASTYPALPNFPTGTQSVDEGGWETFGPSAVAQPGLADPTELTREGIEKVIQDFAAAAERAVRAGFDAVEVHGAHGYLLHQFLTPVANKRTDIYGGSFENRTRLFREVAQAIRAVIPGSMPLIARISATDWIDDEPSWDDDQTVSLVSDLKKLGVDAVDISTGGAVPATIPVEPSYQVKFARRVKQEVGIPTSAVGLITHVGQAQGHLDRGDADIISLGRAALRYPSWPLFAAHELGKTRDEIPYPPSYVRGAW

SEQ ID NO: 8851 - protein, 207 aa, Millettia dura
VMAYKFHEDDHGEVIAEITKPGLEPYLGLHYPATDIPQAARFLFMKNKVRMIVDCHAKHVKVLQDEKIPFDLTLCGSTLRAPHSCHLQYMANMDSIASLVMAVVVNDNEEDGDSSDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 8852 - protein, 438 aa, Zea mays
  misc_feature (128)..(128): Xaa can be any naturally occurring amino acid
VSASKTKIYMVLEYVNGGELFDKIALKGKLTEKEGRKLFQQLIDAVGYCHEKGVCHRDLKPENVLVDAKGNIKVSDFGLSALPQNQRKDGLLHTTCGSPNYIAPEVLLNKGYDGSVSDVWSCGVILYXMLTGSLPFDDQNMVVLYQKILKGNAHIPKWLSQGAQDLLRKILDPNPITRVDVDGIRAHDWFKQGYAPSAPFNDDEEDINVDEEDSLNMTENGIQDKIAINQINAFQLIGMSSCLDLSGFFEKEDASERKIRFASNYPPAYLFEKIESIVRKMGFQVHKSNGKGAESHCHVLQLKVIQDCKGLANLRGKESLLISAEVFEINESLYVVELKKSSGDCSLYRKLCETLSEDLGTCKSQQFLKQDSIRQEIDLLGPWVRSIARIELLPGINHLDALPPKRPPHFCNTFRLCILLWKKLLQCKLQAARVAGRR

SEQ ID NO: 8853 - protein, 183 aa, Capsicum chinense
GAYGIVCSALNSETNENVAIKKVANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRPPELLLNSSDYTAAIDVWSVGCMF

SEQ ID NO: 8854 - protein, 135 aa, Oryza sativa
DEDLQKIGIGLTGFGVFFSFLGIIFFFDKGLLAMGNILFLSGLGLTIGLKSTLQFFTKPKNYKGTISFGAGLLLVLIGWPFFGMLLEAYGFIILFSGFWPTLVVFLQKIPFIGWIFQQPFVASYLGSYRGKRVPV

SEQ ID NO: 8855 - protein, 180 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDLGLARVTSETDSMTEYVVTRWYRPPELLLNSSDYTAAIDVWSVG

SEQ ID NO: 8856 - protein, 215 aa, Unknown
  Mesorhizobium sp. BNC1
MSTLRAGIVPVTPFQQNCTILFDEEEKRGIVVDPGGEVDRIRAAIEQNGLTIEAIWLTHGHIDHAGGAMDLKDALGVEILGPHEAERDLLLNLAAQGRMFGLAEPVRDVTPDRFLNEGDVVSFAGHSFKVFHCPGHSPGHVVFYNDAAKFAHVGDVLFQGSIGRTDLPGGDHAALIRSIKDKLLPLGDDIGFLCGHGPGGRFGGERRTNPFLIGQ

SEQ ID NO: 8857 - protein, 193 aa, Millettia dura
MAYKFHEDDHGEVVSEIRRSDLEPYLGLHYPATDIPQASRFLFKQNRVRMICDCGAKPVKVIQSEELRQPLCLVNSTLRSPHVCHTQYMANMGSTASLVLAIIVNGNDTTRLWGLLVCHHTSPRYVPFPVRYACEFLMQAFGLQLYMEIQLASQKAEKRMLKTQTLLCDMLLRDAPLGIVTQSPNIMDLVKCD

SEQ ID NO: 8858 - protein, 183 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIF

SEQ ID NO: 8859 - protein, 695 aa, Solibacter usitatus
MERQCISEYNFESTDCAGASAARDNTSRKVPRVVAAILTSVIRSTPAATTSAVCRRDGKFERVPMCGIAGYALIDQSAQRARVQAMCDQIRHRGPDDEGVHVDRNCAIGMRRLSIIDLSTGHQPMCNEDGSVWIVFNGEIYEYKELRAELIAHGHQFRTASDTETLLHLYEEEGVEGLRRLRGMFAFAIWDARRNRLMLARDPFGKKPLYYAVLPTGIYFGSEISCLREAGVPLEPDPEALRLYFQFNYIPDPMSAYRAVRRLPAGSWLTWENGQVRQGRYWQPPVPAAQPVAGLSHADAVVKVREKFDEAVRIRMIADVPLGAFLSGGIDSSSIVASMAMQSREPIKTFSIGFEESEFNELPYAAMVARKYGADHHEIVVRPDSIGIIRKFARHFGEPFADASAIPTYIMSEFAARYVKVALSGDGGDELFGGYTSLRQVQKLAAFDRVPQAVRLMMSWASSRMPYSAYGKNFLHMLGRRSALDRYFAFNYAPFHMRSKLLRPDWMLPAESGFLARALPDCILPEDAGALSQVMYFEGTANLTGDMLVKVDRMSMAASLEVRCPLLDHELAELAATIPHAWKVVGGQGKRILLDALGDRLPPELLNRPKTGFGVPLVDWFRTSLRELLWDTLTAERFLAHNIVAPEFLRTLLEEHDSGRRDNSQWLFTLLVLALWFEDIEQPLASPVPARVEGA

SEQ ID NO: 8860 - protein, 604 aa, Pseudomonas syringae
MPLRTDDNWRHGAVLLDPEHTRFALWAPDTSFVNVELQDGQSLAMLPQSDGWFVLEARCKAGTRYRFRIDHELDVPDPASRAQVDDVHSESLVVDPHAYSWQNTAWNGRPWHEAVIYELHVGAMGGYAGVEKHLPRLARLGVTAIELMPLAQFPGDRNWGYDGVLHYAPQSSYGTPEQLKHLIDTAHGLGLMVILDVVYNHFGPDGNYLGSYAKEFFRSDLHTPWGDAIDFRRPQVRDFFVDNALMWLLEYRFDGLRMDAVHAIRDKTFLPEFAERVRSRIEPGRHVWLNLENEFNQASLLEKGFDAQWDDDGHNTLHVLLTGETDAYYSDFAKEPTQKLARLLSEGFVYQGEPTRHGHTRGEPSAHLPPSAFVLFLQNHDQIGNRALGERLPQLCAPAALKAATALLLLSPMIPLMFMGDEWAASEPFLFFTSHHGELADAVREGRRKEFADFAAFADPEKREHIPDPNDIKTFEASRPAFSAVDLDTDIGQDHRSWLQFYTQLLALRHQEIMPRLQGARFLSTDILGDKAVSARWTLGDGSELRIDLNLSEHAVDAPPQTGAREIFSSAEKSSELSPPGTLNAYTAIVSLKASDVLEEQDEQ

SEQ ID NO: 8861 - protein, 530 aa, Vibrio cholerae
MAAKHVLFSTDARQKMLSGVNLLANAVKVTLGPKGRHVVLNKSYGAPTITKDGVSVAKEIELADKFENMGAQMLKQVASKANDEAGDGTTTATVLAQALINEGMKAVAAGMNPMDLKRGIDKAVSAAVEKLHQLAKPCSDTQSITQVGAISANSDHAIGEIIAQAMEKVGRNGVITVEEGQALQNELSVVEGMQFDRGYLSPYFINQPKAGCVELENPYVLLVDKKISHIRELLPILESVAKASRSLLIIAEDVDGDALATLVVNSMRGIIKVAAVKAPGFGEQRKAMLEDIAALTAGRVISEEIGLELEKVTLDDLGSAKKVTINKDNTTIVDGAAEPSALQDRIAQIQHQLEHTTSQYDRDKLQQRIAKLSGGVAVIKIGAATEVEMKEKKDRVDDALHATRAAVEEGIVAGGGVALLKIANELSNLQGDNDDQNVGIRIALRAMEEPLRQIAINAGDEASVIANQVKTGDEHYGYNAATGQFGNMLEMGILDPAKVTRSALQFAASIAGLMITTEAMVSEVDKESAA

SEQ ID NO: 8862 - protein, 1001 aa, Rubrivivax gelatinosus
MSNEHVDSQFERAAAEARAAVDRRVLRPLRDLAVARKLALIVFLLVGVVVGLVYLSKLSSDILSGVRAYVAGDGLWAKGNRDAVFYLVRYAQTHEEADYRQYAAALSVTLGDRQARLELEKPDFDYDVAYAGFLAGRNHPDDIDSLIWLFRTFRNLSYMDRVIQLWTRGDEEMALLRSYGDTIRTQVLNGSLSPAHAALLIGEIEVLNRRLVPIEDAFSTVLGEASRWIAQLLFALMLVTACGLLTLGLVVAGYLTRRINRQIDGLRDGALRMADDDFEQPVEIVSDDELGRLAATFNSMQARLREHRSAIEASAAELQQATAAAQALALQAETASQAKSQFMATMSHEIRTPMNGVLGMTELLLGTALDSRQRRFAQAVYRSGESLLEIINDILDFSKIEAGKLELAPADFTPRALVEDVLELLAPRAQERGLELSFREEPGLPPALHGDALRLRQVLTNLVANAIKFTEHGEVVVEMRRVEPTAAETALATGDRLWVELCVRDTGIGIPPEALSRLFIAFSQASSGMARRYGGTGLGLAISRQLVELMSGSITVRSQPGVGSRFCVRLPLSPASSDVDVDMLELHDMPALRVLVVDDNETNRTVLENLLGAWGMEVVVANDGVHALERLHAERDAARSFDIALIDMQMPRLDGLQLADRISAEPDFADVKLIMLSSVSSPDDAKRAQAVGFKRFVNKPVRKAELRQAILGVSGVAGAGGGSSRKIGAHILVVEDNPVNQEVIGQMLRHFGCRVQLASSALEGLRALCAERFDLIMMDIQMPGMDGVEALGWFRRGPGERFAFRTPPTTPVVAVTANALGGDRERFLGLGFDEYLSKPFRQSQLHTMLSQRLNIPDTGAGELTPAPAEPALAGAPAIPPAATAGALDAQALQRLRDLDPTGANRLLERVVQAFETSTGRLLPQLDEAHAAGDLDGVKHVAHTLKSSSASIGALKLSALCADIEGMIRNNEVQALGPRVAALRAEIASVRGSLHALLLPAA

SEQ ID NO: 8863 - protein, 230 aa, Triticum aestivum
  misc_feature (144)..(144): Xaa can be any naturally occurring amino acid
  misc_feature (178)..(178): Xaa can be any naturally occurring amino acid
MGSEGPSIVTVHVTGFKKFHGVAENPTEKLVTNIKSFIEKRGLPKNLVLGSCEILETAGQGALGTLYKVLESAIADRENGSSAQGQIIWVHFGVNSGASRFALENQAVNEATFRCPDELGWKPQRVPIVPSDGSILRTRETTLXPVKELTKSLRKTGYDVMPFDDPGQFVCNYVYYHXSLRFQKPPGHSSLWFVDGPPSSPKVEEEGPKIHFPPPPPPPKASWLALKLKK

SEQ ID NO: 8864 - protein, 466 aa, Escherichia coli
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKEGEDPGYTLYDLSERLRLRGWQVPAFTLGGEATDIVVMRIMCRRGFEMDFAELLLEDYKASLKYLSDHPKLQGIAQQNSFKHT

SEQ ID NO: 8865 - protein, 191 aa, Millettia richardiana
YKFHEDDHGEVVSEIRRSDLEPYLGLHYPATDIPQASRFLFKQNRVRMICDCHAKPVKVIQSEELRQPLCLVNSTLRSPHVCHTQYMANMGSIASLVMAIIVNGNDKTRLWGLLVCHHTSPRYVPFPVRYACEFLMQAFGLQLYMEIQLASQMAEKRMLKTQTLLCDMLLRDAPLGIVTQSPNIMDLVKCD

SEQ ID NO: 8866 - protein, 255 aa, Populus deltoides
MGRGRVQLKRIENNISRQVTFSKRRTGLLKKAHEISVLCDADVAVIVFSTKGKLFEYSTDSSMESILERYERCSYAEQQFVPHGPEHQGSWFLEHPKLRARVELLQRNLRNYTGQDLDPLSYKELHHLEQKIDTALKSVRSRKNQLVHESLAEMQKKEKALQDQNNILVEQVKKKLKALTEQAQWEQQNLGQNSSSFMLPQAQPPLQPSMLSHPPPTLGGSFQIRGFLNGNKDVEVQTQPSTMPHWMLRHVNDRI

SEQ ID NO: 8867 - protein, 356 aa, Nicotiana tabacum
MDKYELVKDIGSGNFGVARLMRHKETKELVAMKYIERGHKIDENVAREIINHRSLRHPNIIRFKEVLVTPTHLAIVMEYAAGGELFERICNAGRFSEDEARYFFQQLISGVHYCHNMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTIQRIMAVQYKIPDYVHISQDCRHLLSRIFVANPARRITIKEIKSHPWFLKNLPRELTEAAQAAYYRRENPTFSLQSVEEIMKIVEEAKTPAPASRSVSGFGWGGEEEEEEKEGDVEEEEEDEEEEDEYEKQVKQAHESGEVRLT

SEQ ID NO: 8868 - protein, 156 aa, Arabidopsis thaliana
MSLVPTFFGGRRTNVFDPFSLDVWDPFEGFLTPGLTNAPAKDVAAFTNAKVDWRETPEAHVFKADVPGLKKEEVKVEVEDGNILQISGERSSENEEKSDTWHRVERSSGKFMRRFRLPENAKVEEVKASMENGVLSVTVPKVQESKPEVKSVDISG

SEQ ID NO: 8869 - protein, 287 aa, Suaeda salsa
GVHTFTLINRSGKVTYVKFHWRPTCGEKNLLEDEAIRVGGENHSHATQDLYETIAAGNFPEWKLYIQTMDPADEDKFDFDPLDTTKTWPEDILPLQPVGRLVLNKNVDNFFTENEQLAFYPAHVVPGIYFSNDKMLQARTFAYADTHRYRLGVNYLQLPVNAPKCPHTNNHRDGAMTMIHRDEEIDYFPSRFDPVREAERHPIPTAIISGRREKQIIPKENNFKEPGDRYRSWDPARQERFVGRFVKALSDPRLTYEICSIWETYLSQADKSLGMKVASRLNVRPTM

SEQ ID NO: 8870 - protein, 540 aa, Unknown
  Parachlamydia sp. UWE25
MAAKIIKFKEDARQKILKGVRTLADAVKVTLGPKGRNVVIDKSYGTPHITKDGVTVAKEIELEDKFENMGAQMVKEVASKTADKAGDGTTTATVLAEAIYSEGLRNVAAGANPLDLKRGMEKAVKVIVQELKKRSKTVDDRNEIAQVATISANNDAEIGEMIAQAIEKVGRDGTITVEEGKGFETELDVVKGMKFDRGYLSAYFMTNSESQECILEDAYVLIYEKKISAIKEIIPLLQAVVETGRPLLIIAEDVEGEALATLVVNRLRAGLKVCAVKAPGFGDRRKAMLQDIAILTGGELISEEIGLKLETTTIEQLGRVKKAVLTKDETTLVEGAGTKAAILDRASQIKRQIEESTSDYDKEKLQERLAKLVGGVAVIHVGAATEIEMKEKKDRVDDAQRATAAAVEEGILPGGGTAFIRCIPAVNSLADSLEGDEKTGAKIMARSLSAPLRQIAENAGQEGAIILQAVEKMKEKEGYNALTGEYVDMITAGILDPTKVVRCALENAVSVAAMLLTTEAIVADIPEEKPAPAAPVGMDY

SEQ ID NO: 8871 - protein, 201 aa, Millettia richardiana
FPEDDHGEVIAEITKPGLEPYLGLHYPATDIPQAARFLFMKNKVRMIVDCRAKHVNVLQDKKVPFDLTLCGSTLRAPHSCHLQYMENMNCSASLVMAVVVNDNDEDGDSDAVQPQKRKRLWGLVVCHNTTPRFVPFPLRYACEFLAQVFAIHVNKELELEYQIVEKNILRTQTLLCDMLMRDAPLGIVTQRPNIMDLVKCD

SEQ ID NO: 8872 - protein, 178 aa, Piscidia piscipula
LHYPATDIPQATRFLFMKNKVRYIVDCRAKHVKVLQDKKVPFDITLCGSTLRAPHSCHLQYMENMNCSASLVMAVVVNDNDEDGDSDAVQPQKRKRLWGLVVCHNTTPTFVPFPLRYACEFLAQVFAIHVNKELELEYQIVEKNILRTQTLLCDMLMRDAPLGIVTQRPNIMDLVKCD

SEQ ID NO: 8873 - protein, 155 aa, Triticum aestivum
LYRTSLYKKAGWYRSGIPGISSTHASVPTGRFDVLSKADGVPLVAIRLKDSTNFSVFDISENLRRFGWIVPAYTMPADAEHVAVLRIVIREDFNRSLAQRLLADINKIVAELDAHAVHAIKLSNAAAAEGASKSTVDAVTEAFKGLAGNKKAGVC

SEQ ID NO: 8874 - protein, 152 aa, Piscidia piscipula
AYKFHEDDHGEVIAEITKPGLEPCLGLHYPATDIPQAARFLFMKNKVRMIVDCHAKHVKVLQDEKLPFDLTLCGSTLRAPHSCHLQYMANMDSIASLVMAVVVNDNEENGDGSDAVQPQKRKRLWGLVVCHNTTPRFVPFPLRYACEFLAQV

SEQ ID NO: 8875 - protein, 481 aa, Streptococcus pyogenes
DHFENMGAKLVSEVASKTNDIAGDGTTTATVLTQAIVHEGLKNVTAGANPIGIRRGIETATATAVEALKAVAQPVSGKEAIAQVAAVSSRSEKVGEYISEAMERVGNDGVITIEESRGMETELEVVEGMQFDRGYLSQYMVTDNEKMVADLENPFILIMDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPAAPAPAMPAGMDPGMMGGF

SEQ ID NO: 8876 - protein, 349 aa, Anabaena variabilis
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPVGRYTLLYDPIDGSSNTDTNLSLGSIFSIRQQEGDDSDGQAKDLLTNGRKQIAAGYILYGPSTMLVYTMGKGVHSFTLDPSLGEFILSEENIRIPDHGAVYSVNEGNFWQWEESMREYIRYVHRTEGYTARYSGAMVSDIHRILVQGGVFLYPGTVQNPEGKLRLLYESAPLAFLIQQAGGRATTGLVDILDVVPKKLHQRTPLIIGSKEDVAKVESFIQNGH

SEQ ID NO: 8877 - protein, 559 aa, Schizosaccharomyces pombe
LTMCGILAVHHVAEDIEAFKPKALHLSKQLRHRGPDWSGKAIRNQTILCHERLAIVGVESGAQPLVSDDGKLVLTVNGEIYNHLKLRENLKGNYKFKTYSDCEVILYLYREHGPACANMLDGMFSWVLYDQDKDKVVAARDPIGITTLYQGFSSDSPDTAYFASELKALHPVCDKIIAFPPGHYYDSETKQTVRYFKPSWWDENKIPSNPVDYKLLRETLEASVRKRLMAEVPYGVLLSGGLDSSLIASIAARETEKLANSTSQSEEARTITAWPKLHSFAIGLPGSPDLLAARKVADFLHTFHHEHTFTIDEVLMLFVTLFTILRHMMLPLSVQVPPCIYYLVKSRLKVLKWFCLVRDLTKSLVDTYISVMPPLVRPSIPSVCVVLRTCTYPNACVLTSQLWLGVLRLVFLSWIRTFWKLLLTLILRRKCILTVVKKNIFFAKALDTTHDSSLQPYLPQDILWRQKEQFSDGVGYSWIDALKDTAELCISDDEFALPRREWGDDIPTTKEAFWYRKLFDEIFPRQCADTVMRWVPKAEWGCPEDPSGRYQAGHVAALK

SEQ ID NO: 8878 - protein, 449 aa, Unknown
  Synechococcus sp. CC9605
MVRSQRLRSLVRSTPLLLILGVGGVVTAMGISSPGLSLPSASGGSIYDSPKEVIDQVWQIVYRDYLDSTGSYDEATWRQLRSNLLSKSYGGSAESYEAIRGMLASLDDPYTRFLDPKEFKEMQIDTSGELMGVGIQLSLDKDTKELIVVSPIEGTPASRAGVQPKDVIVSIDGASTKGMTTEDAVKLIRGPEGTDVLLGLRRQGQVLNVPLKRARIEIHAVKAMLNTAPNGRKVGYIRLKQFNANATREMRAAIKDLESQAAEGYVLDLRSNPGGLLEASVDIARQWLNEGTIVSTRTREGIRDVRRATGSAVTDKPLVVLIDQGSASASEILSGALQDNSRAQLVGQKTFGKGLVQAVRGLADGSGLTVTIAKYLTPKGTDIHKNGIQPDIEAAMSKKESKNFSVEDLGTQKDSQYKTAEGTLLNQLKKSQAGTTYQPGRANLSFALQ

SEQ ID NO: 8879 - protein, 305 aa, Synechococcus elongatus
MLKVKNCKVAAYMSSEPSDGHDLRRSFRDRQELIDYLQQQFPEAAAVDAQVSPIPGGYQAAIAQLEAINPLRYGKSRNFLDGAVTRLSPYIRHGVLSLATVRDRVLAQIRQRSDGEKLITELAWRDYWQRIYWEWGDRIWRDREPYKTGWDSQQYSEALPPDLQAAETGLACMDRFSRELKETGYLHNHARMWMAAYLVHWRRIRWQAGARWFLQHLLDGDPASNNLSWQWVASTFSTKPYWFNRENLQRYNGDRDCQDCPSRDRCPFDGSYDELADQLFPKAEFRDQPRQGGRWHRDRSNSRQR

SEQ ID NO: 8880 - protein, 833 aa, Triticum aestivum
VRSGRLADSITTRGWRRFAVSGATLGVARAGVGVARAGSERRGGADLPSLLLRKKDSSRAVLSRAASPGKVLVPDGESDDLASPAQPEELQIPEDIQEQTAEVNMTGGTAEKLQSSEPTQGIVETITDGVTKGVKELVVGEKPRVVPKPGDGQKIYEIDPTLKDFRSHLDYRYREYKRIRAAIDQHEGGLEAFSRGYEKLGFTRSAEGITYREWAPGAHSAALVGDFNNWNPNADAMTRDDYGVWEIFLPNNADGSSAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYNFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNKRWLEKCVTYAESHDQALVGDKTIAFWLMDKDMYDFMALDRPSTPRIDRGIALHKMIRLVTMGLGGESYLNFMGNEFGHPEWIDFPRGPQTLPTGKVLPGNNNNYDKCRRRFDLGDAEFLRYRGMQEFDQAMQHLEEKYGFMTSEHQYVSRKHEEDKVIIFERGDLVFVFNFHWSNSFFDYRVGCSKPGKYKVALDSDDALFGGFSRLDHDVDYFTTEHPHDNRPRSFSVYTPSRTAVVYALTE

SEQ ID NO: 8881 - protein, 250 aa, Neisseria meningitidis
MKITPVKALTDNYIWMIQHGNHAVCVDPSEPSPVLEFLVRNRLMLAQTWVTHPHPDHEGGAAALWRGYMESPVYGESDIEAATHTVTAGTQFTFGDGQVTVWATPGHTDRHTSYLLETSDGIHVFCGDTLFSAGCGRVFTGTIEQLYDSFQRFNRLPENTLFYPAHEYTAANLRFAAHIEPDNADIQTALKAAERTPTLPVTLAHERRVNPFLRTEIPAVRQRAEALVGKTLNSGLEVFAALRELKNAYC

SEQ ID NO: 8882 - protein, 290 aa, Corynebacterium diphtheriae
MVTMKQHENIIPTITLNDGTEMPAIGFGTYKLREQDAYRAVRSAIEVGYRHIDTASLYKNEEEVGRAVADAITAGEVARDELFITTKVWNDMHGDQLTQRSFQESLHRLGLDYIDCCMVHWPWPQKGLYVESFAALAKIQGLGQLQSVAVANFYPEVLREIVAETGIAPVLNQVELHPGFSQAEQRAVDRELGVVTEAWSPLGRGDSLNAEAITLIAQCYEKTPAQVTLRWIHQLGCSVVPKSANPQRQRENLDIFDFELNTEDMNSITSLDEQGGRLFVDPHDFPGEVE

SEQ ID NO: 8883 - protein, 886 aa, Neurospora crassa
MCLAFVPLPTEALAYAFNIWAGQLTVHAPAGQMTTTHVLSLPFRKSTQLSLSRAIQQYISAKYDQHPDMFRHDLDTIDALRRDAINVREAHPSGIRKLQMYAAQLVWIGGKFPIDVGADFTWYPALGYHTEHPLVQNNLKYELMNVLYNLAALYSQLAVASNRNSTEGLKTAASWFSHSAGVLTHIKTQVLPELRMPSPPDDMDETTLESLIQLFLAEAQECYWQKAVMDGYKDASIAKLAARVSDLYNEAGEAAMRSEAISSAWIHHMSAKHHHFAAAAQFRAASDCLERKKYGEEIARLRDAVACVNEGLKETRGGYLSKAVVEDLQGLKRRLEEDLKRAEIDNDRVYLHIVPPKTELKRLDRANMAVARVPPQVAKPYEFLGDPSAEFGPALFTKLVPFAVHVAVSIYEERRDRLVNNSIISELESMTSQLHEILSSLNLPGSLQALEKPLGLPGTLVQHADEIRQADALYRLQQGLTDIDKLCSSDLAIFEEGRSLLLAEEEEDSRLRLKYGTERWNRPQSRQDPSPNGGTKLWRQAQDIEGYFGSSTASDQVVREKFNAVRDTLTILAGSDRSIMDFIPNSRRTDIPESLKPALGRLRSAYNDVQRLESRRRKRVESLRARSRADDIKPDILVEAARLERAYPTTAIATAHFEDFFEKRLDRLYESELEAVERDKQEQEKIVQEVKRANKEFEAQKRQVDRAGGGNREREEALQKLDAAYYKYKEIVSNVEVGRKFYNDLSQIVEQWRGLVRGWVSERRRDARSLEEEINMPPLSSLNMHQSSFSYQQQQHHQQPPPPPPQIPFPEPIQPHQPIVEQAHIQSWADNVPQQQPKPVAPGAWAPNMGIKFGSPVAQGQQHQQEQGQPGPVNATWDPSQGIRFG

SEQ ID NO: 8884 - protein, 402 aa, Unknown
  Nostoc sp. PCC 7120
MSDEAERQRGNNLYKNSPLLPVSISQVSTSQLRETEIMSTNINLFSSYQLGELELPNRIVMAPLTRQRAGEGNVPHQLNAIYYGQRASAGLIIAEATQVTPQGQGYPHTPGIHSPEQVAGWKLVTDTVHQQGGRIFLQLWHVGRISHPDLQPDGGLPVAPSAIAPKGEVLTYEGKKPYVTPRALDTSEIPAIVEQYRQGAANALAAGFDGVEIHAANGYLIDQFLRDGTNQRTDEYGGAIENRARLLLEVTEAITSVWDSQRVGVRLSPSGTFNDIRDSHPLETFGYVAQALNRFNLSYLHIFEAIDADIRHGGTVVPTSHLRDRFTGTLIVNGGYTREKGDTVIANKAADLVAFGTLFISNPDLPERLEVNAPLNQADPTTFYGGGEKGYTDYPFLAVANK

SEQ ID NO: 8885 - protein, 445 aa, Unknown
  Phalaenopsis hybrid cultivar
MSKMFGKEVPLSKMAVSKAHGEGSPYFAGWKAYEENRYDAVGNPDGVIQMGLAENQLSFDLLEEYLELHPEAFSWASDSSSFRENALFQDYHGLQTLRQALASFMEKIRGGRSKFDANRIVLTAGATAANEILTFILADRGDALLVPTPYYPGFLRDLQWRTGVTIFPVHCYSSNGFQLTLSSLEKAYAEAKASNFNVRGLLMTNPCNPLGTSASLSLLQDIIHFISDKNIHLISDEIYSGSVFSSTNLFSISDLITDAISEQVHIVYSLSKDLGLPGFRVGALYSYNDRVVKTARRMSSFSLVSSQTQRLLSFMLSDEEFTVRYIEKNRERLRERYELVVNGLKEAGIECLKGEAGLFCWVNMEKLMEEETKEGEAELWKVIIDDLKLNISPGSSCCCAEPGWFRLCFANMSRETLEVALKRLKDFAQKKVAAKKKKMNNVYFC

SEQ ID NO: 8886 - protein, 514 aa, Actinoplanes missouriensis
MTTPEDRTTMIGNTTSRLAADQRAMDSVISGATHDPHAILGAHPHGGHTVIRALRKGATTVAVLHDGERTEMTAVHPDGIFAAELAGTVLDYRLDVDGTQCDDPYRHLPTLGELDLHLIGEGRHEKLWKVLGAQPRGTGVAFAVWAPSAQGVQVIGDFSGWGPYDGWPMRSLGSSGVWELYVPSAHIGSKYKFKILGRDGVWREHADPVAQHTEVPPATASVVYQSSYSWHDEQWMRERARKSWHQEPISCYEVHLGSWRPGLTYTELAEQLVEYVLEIGFTHVELMPVMEHPFGGSWGYQVTGYYAPTSRFGSPDEFRFLVDKLHQAGIGVILDWVPAHFPKDEWALARFDGTPLYEHGDWRRGEQPDWGTYVFDFGRKEVRNFLVANALYWCEEFHADGLRVDAVASMLYLDYSRKDGEWTPNQYGGRENLDAISFLQEMNATVYKHHPGVMTIAEESTAWPGVTRPTHLGGLGFGFKWNMGWMNDTLSYIEKEPIYRQWHHHQMTFATVYA

SEQ ID NO: 8887 - protein, 652 aa, Kluyveromyces lactis
MNDIFAIPFKRALQINLKDAFTVVINNTFYQTAASVEADLTQLDKYRDVLFHLDVCQADLNMLKQYYMALKAIAVKLPDDQVEFTWFNTLGLKSSGMTRNSLRFETFNVLYNIGAMYSSLAVEQRLESTEGLKESCRLFKLSAGCFKFIYEHEVSNNFKFFDEYTLNALVSMMLAQAQQMVWKKACFDDIERHSILSRLALQVALFYQTASKNSNCSPYIRTDWVKSLTSKSHYFMAIAYYRSGLHQVQKQNYAQGICDFQYALTWINKLSLDDELTEWRGEVQALLESAERDNDLIYLQASVQNPSKVKPVMMVQADLFDEIEKKDGNIFKNLLPIDVLESCNAFNERVETYVKEHISNPLESMNKLLISNTPQYMDFKSYYISEQEWNSYSDSLQDLEQLRAYVAGELKLSESILQKDIQENEQMIREHGLLRWKIPSKDKKIESLLADLTNIRNYIENGMKVDTETASLFKTLDHDLVTNVSQPPESSDPIMKEASLILQGRKNHILAAERKIIENRLLPKIVSYYKKTGSKDFEPVFQEHIRMFDGDLLQVQKEKAKNKEMLTKVTLSSPEQVQISRNDPRTLYLEELKHSSNVLSELKENIISGKQFYQDLITALESKLKEIEDYVNERKLQRTELNDTLLCDTNES

SEQ ID NO: 8888 - protein, 389 aa, Leuconostoc mesenteroides
MAPTTLKSSLEDGSVSDNELKYYQMRSNGPGMIIVEAAYVNELGKGWEGGLSAADDDKIEGLSRLASAIHSGGAKAILQLFASGRQSNQTILRGEQIVSASAQPYPHGSHETPRELKHEEISQTIEDFAAATKRAILAGFDGVELHGANLYLLQQFFSPESNRRQDIWGGTLEKRMRFGLAVTAKVGDTIDKYAERPFLLGYRQSPEESTTPGITLADSLAFVQRLVTLQIDYLHLSLKDAFQKPFRDAKAVKQITTYYTEVLPDNVPLMVAGLIKQPMQVESLLDEGVTFAAMGRALIADPNWVQKVKLNDEKSIRYAVSPADFDLLGVPKPLKKWLLTRFKNGFPVTTDIEFDPKTPWKYYKSMPTQPRQQIDPTKLMTLKKRVDDN

SEQ ID NO: 8889 - protein, 192 aa, Piscidia piscipula
AYKFHEDDHGEVVSEIRRSDLEPYLGLHYPATDIPQASRFLFRQNRVRMICDCHAKPVKVIQSEELRQPLCLVNSTLRSPHVCHTQYMSNMGSIASLVMAIIVNGNDKRRLWGLLVCHHTSLRYVPFPVRYACEFLMQAFGLQLYMEIQLASQMAEKRMLKTQTLLCDMLLRDAPLGIVTQSPNIMDLVKCD

SEQ ID NO: 8890 - protein, 443 aa, Glycine max
MDRRSHPTGTVSTRNILFNKYEIGKLLGQGNFAKVYHGRNLSTNESVAIKVIKKERLQKERLVKQIKREVSVMRLVRHPHIVELKEVMANKAKIFMVVEYVKGGELFAKVAKGKLTEDLARKYFQQLISAVDFCHSRGVTHRDLKPENLLLDQNEDLKVSDFGLSTLPEQRRADGMLVTPCGTPAYVAPEVLKKKGYDGSKADLWSCGVILFALLCGYLPFQGENVMRIYRKAFRAEYEFPEWISPQAKNLISNLLVADPGKRYSIPDIMRDPWFQVGFMRPIAFSIKESYVEDNIDFDDVENNQEEEVTMRKPARPFYNAFEIISSLSHGFDLRSLFETRKRSPSMFICKFSASAVLAKVEAVAKKLNFRVTGKKEFVVRMQGTEEGRKGKLAMTVEVFEVAPEVAVAEFTKSAGDTLEYVKFCEEQVRPSLKDIVWSWQGD

SEQ ID NO: 8891 - protein, 547 aa, Mannheimia succiniciproducens
MAAKDVKFGNDARVKMLAGVNVLADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVAAVVTELKALSKPCETSKEIEQVGTISANSDSIVGQLIAQAMEKVGKEGVITVEDGTGLEDELDVVEGMQFDRGYLSPYFINKPETATVELDSPFILLVDKKISNIRELLPVLEAVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVEDALHATRAAVEEGIVAGGGVALIRAASKAAASLQGDNEEQNVGIKLALRAMESPLRQIVANAGEEASVVASAVKNGEGNFGYNAGTEQYGDMIAMGILDPTKVTRSALQFAASIAGLMITTEAMVTELPKDDKLDAAAAMGGMGGMGGMM

SEQ ID NO: 8892 - protein, 203 aa, Millettia grandis
MAYKFHEDDHGEVIAELKKPGLEPYLGLHYPATDIPQATRFLFMKNKVRMIVDCRAKHVKVLQDKKIPFDLTLCGSTLRAPHSCHLQYMENMNSSASLVMAVVVNDNDEDGDSSDAVQPQKRKRLWGLVVCHHTTPRFVPFPLRYACEFLAQVFAIHVNKELELEYQIVEKNILRTQTLLCDMLMRDAPLGIVSQRANIMDLV

SEQ ID NO: 8893 - protein, 578 aa, Zea mays
MAAASLRKGNARLPPEVNRALFVRNLPFNISSEEMYDIFGKYGAIRQIRLGNAKDTRGTAYVVYEDIYDAKNAVDHLSGFNVANRYLIVLYSQLNRMSKKTDIKKKEDEITRLQENETGSSMVSSTENKMNELVSPVARAAKPSRQLNFIDISCLATFEVLKNTCRQILVASLSLASFSVARGRSPHSTTSSATTTLNAYFFLRFSDECVLLVAAASLSSLPRSMAMKPVDDAPSNYPTTVVDVSTLRTNHAVGQTQIAPSDDHARTPCTSHAEGLIPNLVDVSEDVPLVDWSTLHIVESYDEEGRLAVMADEQMYASLGLMIDDEIGANQGGVIQEIDAHGCSAHDVGGYIHETEYPNQAEDLTPSNSLFIYDKDNPKIELGTMFPDMKAFRLALRQYAINKEFELATEKSCKTKFRGHCKQKTNDCPWQIVGAKMKILPTIKVTLLVDEHKCTSSSRILTTMPSQAWVADKALPLLRKNPNMGAKAMQIYLQDEYNVTIGYDTVWRGRERALHELYGGWNESFSLLLNWKADVEKRSPGSVVEIDTKIVDEKNPTGGSGQAIFAGEGMADKDQSHD

SEQ ID NO: 8894 - protein, 205 aa, Millettia grandis
AYKFHEDDHGEVIAEVKRPGLEPYLGLHYPATDIPQAARFLFMKNKVRMIVDCHAKHVKVFQDEKLPIDLTLCGSTLRAPHSCHLQYMANMDSIASLVMAVVVNDNEEDGDSSDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 8895 - protein, 180 aa, Tephrosia villosa
GLHYPATDIPQAARFLFMKNKVQMIVDCHAKHVKVLQDEKLPLDLTLCGSTLRAPHSCHLQYMANMDSIASLVMAIVVNDNEEDGDSSDAVQPQKRKRLWGLVVCHNTSPRFVPFPLRYACEFLAQVFAIHVNKEIELEYQIIEKNILRTQTLLCDMLLRDAPLGIVSQSPNIMDLVKCD

SEQ ID NO: 8896 - protein, 130 aa, Arabidopsis thaliana
  misc_feature (3)..(4): Xaa can be any naturally occurring amino acid
  misc_feature (11)..(11): Xaa can be any naturally occurring amino acid
  misc_feature (17)..(17): Xaa can be any naturally occurring amino acid
  misc_feature (34)..(34): Xaa can be any naturally occurring amino acid
  misc_feature (52)..(52): Xaa can be any naturally occurring amino acid
  misc_feature (75)..(75): Xaa can be any naturally occurring amino acid
KLXXDLLVENXKETGWXTPIHVDAASGGFIAPFXYPELEWDFRLPLVKSINXSGHKYGLVYAGIGWVIWRNKEDXPEELIFHINYLGADQPTFTLNFSKGSKASQLNTQLYPQFGATEGPGNFGDFQGGF

SEQ ID NO: 8897 - protein, 152 aa, Zea mays
MSLVRRSNVFDPFSMDLWDPFDTMFRSIVPSATSTNSETAAFASARIDWKETPEAHVFKADLPGVKKEEVKVEVEDGNMLVISGQRSREKEDKDDKWHRVERSSGQFVRRFRLPENTKVDQVKAGLENGVLTVTVPKAEEKKPEVKAIEISG

SEQ ID NO: 8898 - protein, 105 aa, Candida albicans
MNQQNARDIELREQDRWLPIANVARIMKNTLPPTAKVSKDAKECMQECVSEFISFITSEASDKCLKEKRKTINGEDILYSMYDLGFENYAEVLKIYLAKYREARK

SEQ ID NO: 8899 - protein, 481 aa, Capsicum annuum
MDSITIDTINPKVLKCEYAVRGEIVTIAQKLQQDLKDNPGSHPFDEILYCNIGNPQSLAQQPITFFREVLALCDHPSILDKSETQGLFSADAIERAFQILDQIPGRATGAYSHSQGIKGLRDTIASGIEARDGFPADPNDLFLTDGASPAVHMMMQLLIRSQNDGILCPIPQYPLYSASIALHGGTLVPYYLDEQTGWGLEISELEHQLNTAKSNGIDVRALVVINPGNPTGQVLGEANQREIVEFCKKEGLVLLADEVYQENVYVPDKKFHSFKKITRSMGYGEKDISLVSFQSVSKGFYGECGKRGGYMEITGFSPEVREQIYKLASVNLCSNISGQILASLVMSPPKVGDESYESFSAEKEAVLSSLARRAQALQDALNSLEGVTCNRAEGAMYLFPRINLPDKAIKAAEVAKTAPDAFYAKLLLNATGIVVVPGSGFRQVPGTWHFRCTILPQEEKIPAIVSRLTEFHKKFMDEFCG

SEQ ID NO: 8900 - protein, 338 aa, Ralstonia solanacearum
MKRINLTRYLIEEQREHNTIPAELRLLLEVVARACKAISHSVNKGALAGVLGSAGTGNVQGETQQKLDVIANEVLLEANEYGGNLAAMASEEMESFYEIPHRYPKGEYLLLFDPLDGSSNIDVNVSIGTIFSVLHMPKPGQTVTEADFMQPGVRQVAAGYAVYGPQTTLVLTVGNGVHMFTLDREVGSFILTNRDVKIPADTKEFAINMSNMRHWAPPVRRYIDECLAGTEGPRGKDFNMRWIASMVADVHRILTRGGIFMYPWDKREPGKAGKLRLMYEANPMAFLVEQAGGAATNGHQRILEIQPEKLHQRVAVILGSKNEVDRVTQYHREAQQTA

SEQ ID NO: 8901 - protein, 235 aa, Agapanthus praecox
MGRGKIEIKRIENTTNRQVTFCKRRNGLLKKAYELSVLCDAEVALIVFSTRGRLYEYSNNSIKSTIERYKKACADSSNSTAVVEVNTQQYYQQEAAKLRHQIQSLQNSNRHLMGDSLSSLSIKELKQLENRLERGITRIRSKKHELLFAEIEYMQKREAELQNDNMYLRAKITDNERAHQVSVVQSGTEYDTLPTFDSRNYYTHVTMLEAAPHFSHHQDHTALHLGYETKADPTE

SEQ ID NO: 8902 - protein, 476 aa, Cyanidioschyzon merolae
MTAKVESKVREEEKGSNPSTAAADDSGAVIPTLKPRPKPAVEPLEREGVEFDPQRGLVFEKTRSSKWMSEKELNELPLLQRINWLSTSIIFTPLIGTLIGIWFVPLQRKTLVLAIVTYFCCGLGITGGYHRLWSHRSYEAHWLVQVILACFGAAAFEGSARYWCRLHRAHHRYVDSDRDPYAVEKGFWYAHLWWMVFKLPRQRQGRVDITDLNANPILRFQHRYYLQIAILFSFVIPLTISTLGWGDFWGGLVYACLGRMLFVQQSTFCVNSLAHWWGEQTFSRRHTSYDSVITALVTLGEGYHNFHHEFPHDYRNGVVWYHWDPTKWVIRLLSWAGLAWHLVRFPRNELVKARLQVRQEILDEAKKRVDWGKPIESLPVWTWKDVQRLAKEENRLLVVIEGIVHDCTRFKVQHPGGQRILEFWNVRDATQAFNGDVYNHTKAARNLLAHLRVAQLKEIYEPECDESTTEMSTKSS

SEQ ID NO: 8903 - protein, 376 aa, Triticum aestivum
  misc_feature (233)..(233): Xaa can be any naturally occurring amino acid
  misc_feature (268)..(268): Xaa can be any naturally occurring amino acid
  misc_feature (324)..(324): Xaa can be any naturally occurring amino acid
MAATVAVDNLNPKVLKCEYAVRGEIVIHAQRLQQQLKTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSRGIDVRALVVINPGNPTXGQVLAEENQYDIVKFCKNEGLVLLADEVYQENIYXDNKKFHSFKEDSEILGDTAREDLPLVSYQSVSKGILWVSVGKRGWVTWEITGLQCXPLREQIYKIASVNLCSNITGQILASLVMNPPKASDESYASYKAEKEGPCTLL

SEQ ID NO: 8904 - protein, 423 aa, Unknown
  Thermus sp. Z-1
MTENAEKFLWGVATSAYQIEGATQEDGRGPSIWDAFAQRPGAIRDGSTGEPACDHYRRYEEDIALMQSLGVGAYRFSVAWPRILPEGRGRINPKGLAFYDRLVDRLLASGITPFLTLYHWDLPLAQEERGGWRSRETAFAFAEYAEAVARALADRLPFFATLNEPWCSAFLGHWTGEHAPGLRNLEAALRAAHHLLLGHGLAVEALRAAGAKRVGIVLNFAPRYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEGRLRAREEGVDLRGYFVWSLMDNFEWAFGYTRRFGLYYVDFPSQRRIPKRSALWYQ

SEQ ID NO: 8905 - protein, 315 aa, Brassica napus
  misc_feature (115)..(115): Xaa can be any naturally occurring amino acid
WPNALRYFELNTGAKIPSVGLGTWQASPGLVGDAVAAAVKIGYRHIDCAQIYGNEKEIGTVLKKLFEDNVVKREELFITSKLWCTDHDPQDVPEALKRTLQDLQLDYVDLYLMHXPVRMKKGSVGAKPENLLPVDIPSTWKAMEALHDSGKARAIGVSNFSTKKLADLMELARVPPAVVQVECHPSWRQTKLREFCKSKGLHLTAYSPLGSPGTTWLKSDVLKNPILNTVAKKLGKSAAQVALRWGLQMGNSVLPKSTNEGRIRENFEVFDWSIPDDLFSKFPEIEQARLLTAPFFVHETLSPYKSLEELWDGEI

SEQ ID NO: 8906 - protein, 532 aa, Oceanobacillus iheyensis
MAKKDESMNKSNLENDMSLTNRQGHPVTNNQNIRTVSNRGPATLENYDFIEKISHFDREKVPERIVHARGAGAHGYFETYGTVGNDPVSKYTRAKVFQDKGKQTPVFVRFSTVVHGNHSPETVRDPRGFAVKFYTEDGNWDLVGNNLKIFFIRDAMKFPDMIHAFRPDPVTNIQDSERFFDFCANSPESFHMVTFVYSPWGIPANYRMMQGSGVNTYKWVNKDGEAVLVKYHWEPKQGIKNLTTKEAEEIQATNFNHATQDLYDAIENGDYPEWELFVQIMSDDEHPELDFDPLDDTKLWPEDQFPWHPVGKMVLNKNPENYFTEVEQAAFGTGVLVDGLDFSDDKMLQGRTFSYSDTQRYRVGANYLQVPVNESKKRVATNHEGGQMRQKNDKAPSQNPHINYEPSVLGGLEENEQTGKEYTPHIEGNLVRESIDRNDNTKQAGHTFREFEEWEKAELISNLVGDLSVSDQRIQDKMIALAEEADDEYGRRLREGLEQAKKMGTPHNPLGAKDAEQAPKKAIDKGHDADPY

SEQ ID NO: 8907 - protein, 474 aa, Unknown
  Silicibacter sp. TM1040
MADTRPVIWWIRRDLRLRDNPALRAAQEAGGPIIPLYIHDAQEEALGAAPKFRLGLGLERFAKTLEEKGSRLIVRRGDALEVLREVIAESGAGHVIWSRLYDPAATKRDAKIKEALKASDIKAKSTGGRLLFEPWTVDTKDGGMYRVYTPFWKAVRTRDVAELTAAPSRLAAPESWPSGEALADLGMDAAMRRGGAIVAQHCRVGEDAALAQLDDFLTERVSNYKAHRDFPARAATSELSENLAWGEISPHRMWHLGAQAMQDGQPGAEHFLKEVVWREFAYHLMHRSPRILTRNWREEWDGFPWQDDPGDALQRWQQGQTGYDFVDAAMRELYVTGKMHNRARMIVASFLTKHLMIHWKYGLQWFEDCLVDWDPASNAMGWQWVAGSGPDAAPFFRIFNPDGQLEKFDPKGDYARRWLPEGQANPPETAMAYFEAIPRRWSLHPDQSRVSPIIGLKEGRERALSAYKESRNQS

SEQ ID NO: 8908 - protein, 336 aa, Vibrio fischeri
MSEIRTLGEFIVAKQHDFPHASGELSSLIGSIKLAAKIVNREINKAGLVDITGASGEENIQGEQQQKLDVYANDKFKSALEARDQVCGVASEEEDEAVAFNKELNKNAKYVVLMDPLDGSSNIDVNVSVGTIFSIYRRISPIGTPATEEDFLQPGHKQVAAGYIIYGSSTMLVYTTGNGVHGFTYDPSLGVFCLSHENMQIPKDGNIYSINEGNYIRFPEGIKQYLKFCQESKPEDNRPYTSRYIGSLVADFHRNLLKGGIYLYPSTQAYPNGKLRLLYECNPMAMLIEEAGGKATDGEQRILDIKPSELHQRVPFFVGSTNMVNKVHAFLDEWRD

SEQ ID NO: 8909 - protein, 196 aa, Tephrosia villosa
DRVMAYKFHEDDHGEVIAEIRRSDLEPYLGLHYPATDIPQASRFLFKQNRVRMICDCHAKPVKVIQSEELRQSLCLVNSTLRSPHVCHTQYMANMGSIASLVMAIIVNGNDTTRLWGLLVCHHTSPRYVPFPVRYACEFLMQAFGLQLYMEIQLASQMAEKRILKTQTLLCDMLLRDAPLGIVTQSPNIMDLVKCD

SEQ ID NO: 8910 - protein, 362 aa, Pisum sativum
MGATTTDPIPLLTPYNMGKFKLSHRVVMAPLTRTRSYNNVPQPHAILYYSQRASQGGLLIAEATGVSDTAQGLPDTPGIWTKQQVEAWKPIVDAVHAKGAIFFCQIWHVGRVSNSSYQPNGQAPISSTDKAITSNDQQQFTAPRRLRTDEIPNIVNDFKLAARNAIEAGFDGVEIHGAHGYLLDQFMKDKVNDRTDEYGGSLENRCRFPLEVVEAVVNEIGAERVGIRLSPFAEFAESGDSNPNALGLYMVNALNKYNILYCHMVEPRIIVTFDPVETPHCLEPMRKAFNGTFMVAGGYNRQDGIKAIAENRADLVVYGRWFISNPDLPKRFALNAPLNKYNRETFYSSDPVIGYTDYPFLE

SEQ ID NO: 8911 - protein, 475 aa, Enterococcus faecium
MKLKKNFLWGGSIAAHQCEGAWQEGGKGPAIMDYVRQGSYQVPRQIDTIISSEATYPSHMGIDLYHQYKSDIRLFSEMGFTALRISIDWSRIFPNGDDEQPNQEGIMYYIDVVDTLLSYDIEPIVTLYHFEMPKNLVQKYGSWTNRKVIELYLKFCQTMFESLKGKVHYWVTFNEMNHIDPQTEATDIFTYIIAGLKYSELENKSQTLAEIGYNMTVASCSAIVLGKKIDPENKIGCVFGIEPVYPVDCNPTNVMNAFKQMDRDFYQIDAMCTGKFPDYKINEYADQGIKLTITENDKYMFSKGTLDFIGMNYYASSVAKYEGAAEEKSALFGGLQNPYLVTSKWGWTIDPTGLRYLLNYTYRKYGLPIIITENGLGAIDVLTDDKNIHDEYRIEYLKQHIQQMKIAIEEDQVDCFGYLTWAPIDLVSATTGEMKKRYGFIYVDKDDEGNGTLERYKKDSFYWYKEVIGSNGDIL

SEQ ID NO: 8912 - protein, 473 aa, Xylella fastidiosa
MVLLSFSLSAKNPSGVVMSPPVEEMEMPESNDVNVPLDEIRRFVSVYNAIKQAYVDPVNDRKLMHSAVRGLLSDLDPHSTYFDKEDADAFDEQTSGVYDGIGVELQEQSDNTLKVIAPIDDTPAARAGLRPGDLIVAINGKPLANVDAMKPLRGAPGSQVTLTIVRDKNGKPFDMTIKRETIHIASVRSRMLEPGYGYIRISVFQADTGNDFHKHLGQLKQQAGGKLRGLLLDLRSNPGGLLTAAVQVADALLDKGNIVSTRGRISASDTRFDATLGDLLDGLPLVVLVDAGSASASEVLVGALSDNHRARVIGSCTFGKGSVQTLLPLDNGDSVKLTTARYYTPSGRSIQARGIVPDLLLKPDGVGAADLSGSGIDRSEAGLPGHLRGTDEGVPGCTSSDPLPGDTPIMTALLELKQPGSAVQAKKAIPVKVVSDVKSATKSPLSVFGKDRAVKRVPVVSPTSEQVDGQPSK

SEQ ID NO: 8913 - protein, 368 aa, Pisum sativum
MNLNTDAALTTSDPIPLLTPYKMGNFNLSHRVVLAPLTRMRSYNNVPQPIAINYYAQRASQGGFLIAEATGVSDTAQGYPNTPGVWTKDQVEAWKPIVDAVHAKGSVFFCQIWHAGRVSNSIYQPNGQAPISSTDKSLTSNEEQQFTAPRRLRTDEIPDIVNDFKIAARNAIEAGFDGVEIHGAHGYLVDQFMKDKVNDRTDEYGGSLENRCRFALQVVEAVANEIGADKLGIRLSPFAEYAESGDSNPNALGLYMVNALNKYNILYCHMVEPRLIHTFDPVETPHSLEPMRKAFNGTFMVAGGYNRQDGINAIAENRADLVVYGRLFLANPDLPKRFALDAPLNKYHRETFYSSDPVLGYTDYPFLE

SEQ ID NO: 8914 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVEGLTHPYMEAYHDPTDEPVCESKFDWSFNDADLPVDTWRVMMYSEILDFHQTVGVANETEGSEQPDSQVEQNNLDSANGA

SEQ ID NO: 8915 - protein, 368 aa, Pisum sativum
MGIKKVEMSAADPIPLVTPYKMGNFNLSHRVVLAPLTRTRSYNNVPQPHAILYYSQRASQGGLLITEATGVSDTAQGYPNTPGIWTKEQVEAWKPIVDAVHAKGGVIICQIWHVGRVSNSCYQPNGQTPISSSDKSLTSSHAQQFTPPRRLSTDEIPDIVNDFRLAARNAIEAGFDGIEIHGAHGYLIEQFMKDEVNDRTDEYGGSIENRCRFALEVVEAAVNEIGADKVGIRLSPFAEHSECGDSSPKELGLYMVNALNKYNLLYCHMVEPRIKSAFEVVDNSPHSLVPMRKAFNGTFIVAGGYDRQDGINAVAENKTDLVVYGRLFLANPDLPKRFALDAPLNKYNRETFYTSDPVLGYTDYPFLD

SEQ ID NO: 8916 - protein, 206 aa, Lonchocarpus phaseolifolius
RVMAYKFHEDDHGRVIAEVKKPGLEPYLGLHYPATDIPQATRFLFMKNKVRMIVDCRAKHVKVLQDKKVPFDLTLCGSTLRAPHSCHLQYMENMNCSASLVMAVVVNDNEEDGDSDAVQPQKRKRLWGLVVCHNSIPRFVPFPLRYACEFLAQVFAIHVNKELELEYQIVEKNILRTQTLLCDMLMRDAPLGIVTQRPNIMDLVKC

SEQ ID NO: 8917 - protein, 2471 aa, Candida albicans
MSMNFFNSSEPARDHKPDQEKETVMTTEHYEFERPDVKAIRNFKFFRSDETETKKGPNLHISDLSPLESQSVPPSALSLNHSIIPDQYERRQDTPDPIHTPEISLSDYLYDQTLSPQGFDNSRENFNIHKTIASLFEDNSSVVSQESTDDTKTTLSSETCDSFSLNNASYLTNINFVQNHLQYLSQNVLGNRTSNSLPPSSSSQIDFDASNLTPDSIPGYILNKKLGSVHQSTDSVYNAIKIPQNEEYNCCTKASASQNPTNLNSKVIVRLSPNIFQNLSLSRFLNEWYILSGKHSSKEHQIWSNESLTNEYVQDKTIPTFDKESARFRPTLPINIPGILYPQEIINFCVNSHDYPLEHPSQSTDQKRFAMVYQDNDYKTFKELSMFTLHELQTRQGSYSSNESRRKSSSGFNIGVNATTTEAGSLESFSNLMQNHHLGATSTNGDPFHSKLAKFEYGVSKSPMKLIEILTDIMRVVETISVIHELGFVHNGLTSSNLLKSEKNVRDIKITGWGFAFSFTENCSQGYRNKHLAQVQDLIPYMAPEVLAITNSVVDYRSDFYSLGVIMYELVLGILPFKNSNPQKLIRMHTFENPIAPSALAPGWISEKLSGVIMKLLEKHPHNRYTDCHSLLHDLIEVKNMYISKLLDSGETIPNSNLNLSDRQYYLTKENLLHPEKMGITPVLGLKESFIGRRDFLQNVTEVYNNSKNGIDLLFISGESGRGKTIILQDLRAAAVLKQDFYYSWKFSFFGADTHVYRFLVEGVQKIITQILNSSEEIQNTWRDVILTHIPIDLSILFYLIPELKVLLGKKYTSIYKHKIGMGMLKRSFKEDQTSRLEIKLRQILKEFFKLVAKQGLSIFLDDVQWCSEESWRLLCDVLDFDSSGEVRESYNIKIVVCYALNADHLENVNIEHKKISFCQYAKQSHLNLREFSIPHIPLEDAIEFLCEPYTRSHDHECNSKKSDVIANLNCTNEYQQNTCKVIPSIIQELYQSSEGNVLLLIFLTRMTKLSGKVPFQRFSVKNSYLYDHLSNSNYGTTRKEILTNYLNMGTNSDTRALLKVAALISNGSGFFFSDLIVATDLPMAEAFQLLQICIHSRIIVPTSTYYKIPMDLIASDQTPFDLTDDNIWKLATLCSYKFYHDSICTHIIKELNASGEFKELSRLCGLRFYNTITKERLLNIGGYLQMATHFRNSYEVAGPEENEKYVEVLVQAGRYAISTYNMKLSQWFFNVVGELVYNLDSKTQLKSVLTIAENHFNSREFEQCLSVVENAQRKFGFDRLIFSIQIVRCKIELGDYDEAHRIAIECLKELGVPLDDDDEYTSENSLETCLGKIPLSVADIRGILKIKRCKNSRTLLMYQLISELIVLFKLQGKDKVRRFLTAYAMSQIHTQGSSPYCAVILIDFAQSFVNETTTSGMLKAKELSIVMLSLINRAPEISLSYVQSIYEYYFSCHAVFFESIEKMSDLIHPGNASSHCTRSSYYSSFHLIVNVSKIFFSCMNGESFKMFSTFKCKSYLTGDPQMPEMDNFLYDSEMLLAGHSELNEFMRKYQSFNQTSVGKFCYYLIVLLVMSREHRFDEAADLVLKVLEDLSEKLPVSFLHHQYYLICGKVFAYHQTKTPESEEQVERILARQFERYELWASTNKPTLLPRYLLLSTYKQIRENHVDKLEILDSFEEALQTAHKFHNVYDMCWINLECARWLISINQKRHRISRMVKQGLKILRSLELNNHLRLAEFEFDEYIEDEDHRNKWAGLTNNPTLDTVTTWQQQNMPDKVSPCNDKQLVHGKQFGKKEFDSHLLRLHFDGQYTGLDLNSAIRECLAISEALDENSILTKLMASAIKYSGATYGVIVTKKNQETPFLRTIGSQHNIHTLNNMPISDDICPAQLIRHVLHTGETVNKAHDHIGFANKFENEYFQTTDKKYSVVCLPLKSSLGLFGALYLEGSDGDFGHEDLFNERKCDLLQLFCTQAAVALGKERLLLQMELAKMAAEDATDEKASFLANMSHEIRTPFNSLLSFAIFLLDTKLDSTQREYVEAIQSSAMITLNIIDGILAFSKIEHGSFTLENAPFSLNDCIETAIQVSGETILNDQIELVFCNNCPEIEFVVGDLTRFRQIVINLVGNAIKFTTKGHVLISCDSRKITDDRFEINVSVEDSGIGISKKSQNKVFGAFSQVDGSARREYGGSGLGLAISKKLTELMGGTIRFESEEGIGTTFYVSVIMDAKEYSSPPFSLNKKCLIYSQHCLTAKSISNMLNYFGSTVKVTNQKSEFSTSVQANDIIFVDRGMEPDVSCKTKIIPIDPKPFKRNKLISILKEQPSLPTKVFGNNKSNLSKQYPLRILLAEDNLLNYKVCLKHLDKLGYKADHAKDGVVVLDKCKELLEKDEKYDVILMDIQMPRKDGITATRDLKTLFHTQKKESWLPVIVALTANVAGDDKKRCLEEGMFDFITKPILPDELRRILTKVGETVNM

SEQ ID NO: 8918 - protein, 554 aa, Unknown
  Shewanella sp. MR-4
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSSIGEPVQYYTRDWQSFDAVKDNGASQEELRDALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLASAAETVPGGKSVACSTPEALAWDESLRGIIDPSGRAVRSVHAASY

SEQ ID NO: 8919 - protein, 210 aa, Pongamia pinnata
YDRVMAYKFHEDDHGEVIAEITKPGLEPYMGLHYPATDIPQAALFLFMKNKYRMIVDCHAKHVKVLQDEKLPFDLTLCGSTLRAPHSCHLQYMANMDSIASLVMAVVVNDNEEDGSSSDAVQPQKRKRLWGLVVCHNTTPRFVPFPLRYACEFLSQVFAIHVNKEIELEYQIIEKNILRTQTLLCDMLMRDAPLGIVSQSPNIMDLVKCD

SEQ ID NO: 8920 - protein, 119 aa, Cicer arietinum
LVNVMKSFENLNHWREEFLIQASPSDPENFPFVVLGNKIDVDGGNSRVISEKKAKAWCASKGNIPYFETSAKEGFNVEAAFQCIAKNALKNEPEEEMYLPDTIDVGSGGRQQRSTGCEC

SEQ ID NO: 8921 - protein, 446 aa, Corynebacterium diphtheriae
MARSVVVWFRDDLRVHDNPALMKAWELVRANPADLHAVYIANEVGVRPLGGAVKWWLHHSLLALSEQLAQRGVRLHVLSGDPLTLLPQLVTSCGATAVTMNRRYDPAARSIDDAFVADASAHDVEVYDFPCHLLAEPGEITTTTGGSYKVFTPFSRNLRDAIGDLPLDTLAAPPKAEQPIDDTETQAAIADLGWDAWWAASISKAWTPGEPAAREALAELDDILPRYLDDRDRPDIDGTSRLSPRLRFGELSVAEVWNHAHTSEGFRRQLMWRDFAWHRLDAHPDMATANIRPEFDHFPWDGGDFEAELNAWRHGRTGIALVDAGMRELWATGTMHNRVRMVAASLLVKNLGIHWRHGEQWFWDTLVDADPASNPFNWQWVAGSGDDAAPYFRIFNPDTQARRFDPDGTYRTRWLPIMSADYPEEAIVDLKESRLRALDAYNACKR

SEQ ID NO: 8922 - protein, 681 aa, Mesorhizobium loti
MTSNDPLLQPYQLKHLTLKNRVMSTSHEPAYSEDGMPKQRYRLYHAEKAKGGMALTMTAGSAIVSRDSPAAFGNLHVYDDRIVPWLAELAEACHEHDCKVMIQITHLGRRTGWNKADWLPVLSASPVREPAHRAFPKTIEDWDIERIVADYASAAQRCQAAGLDGIEFEAYGHLMDGFWSPATNHRDDEYGGSLDNRLRFTNMVLDAVRAAVGEKFVVGIRMVADEDFSQGLSKEEGIEIARRLAGSGKVDFLNIIRGSIESDAALTKVIPVTGMRSSPHLDFAGEVRAATKFPTFHAARISDVATARHAIATGKLDMVGMTRAHIADPHIIRKVMEGREHEIRPCVGATYCLDRIYEGGEALCVHNAATGREAEIPHIIVKTEGPKRKVVVVGAGAGGLEAARVAAERGHQVTILEASSQAGGQVRLATQNPRRKELIGIIDWRLAELDRLGVEIRYDTWAEKDDILALAPDVVIVATGGLPQNPPLSAGDNLVTSSWDIMAGSVKPAENVLLFDDNGGHQGMGAAELIANAGSKLELVSPERFFAPEMGGMNHVPYMRAFQERGVTITINTRLRSVRREGNQLVAELASDFADGWRGERRVDQVVVEHGTAPLDDLYLSLKPLSKNGGAIDYERLVGGGDIFPVRNPEAGFVLLRIGDAVASRNIHAAIYDGIRFGLRI

SEQ ID NO: 8923 - protein, 402 aa, Arabidopsis thaliana
MATENLTDKNVVFRKLKSKSENKVCFDCSAKNPTWASVPYGIFLCIDCSAVHRSLGVHISFVRSTNLDSWSPEQLRTMMFGGNNRAQVFFKQHGWNDGGKIEAKYTSRAADMYRQTLAKEVAKAMAEETVLPSLSSVATSQPVESSENGFTSESPKESSLKQEAAVVSSPKASQKVVASTFKKPLVSRKSGKTGGLGARKLTTKSKDNLYEQKPEEPVPVIPAASPTNDTSAAGSSFASRFEYFDDEQSGGQSGTRVLSHVAPPKSSNFFNEFGMDSAFPKKSSSSSSKAQVEETDEARKKFSNAKSISSAQFFGNQNRDADLDSKATLQKFSGSAAISSSDLFGHGPDDSNIDITASDLINRISFQAQQDMSSIANLAEETKNKLGTFASSIFSDLQDRML

SEQ ID NO: 8924 - protein, 686 aa, Pseudomonas putida
MAFEAMFQPIQIGKLTIRNRVLSTAHAEVYATDGGMTTDRYVKYYEEKAKGGIGLAICGGSSVVAIDSPQEWWASVNLSTDRIIPHFQNLADAMHKHGAKIMIQITHMGRRSRWDGFNWPTLMSPSGIREPVHRATCKTIEVEEIWRVIGNYAQAARRAKEGGLDGVELSAVHQHMIDQFWSPRVNKRTDEWGGTFEGRMKFGLEVLKAVRAEVGDDFCVGMRICGDEFHPDGLSHEDMKQIAAYYDATGMLDFIGVVGSGCDTHNTLANVIPNMSYPPEPFLHLAAGIKEVVKVPVLHAQNIKDPNQATRILEGGYVDMVGMTRAHMADPHLIAKIKMGQIDQIKQCVGANYCIDRQYQGLDVLCIQNAATSREYMGVPHIIEKTTGVKRKVVVVGAGPAGMEAARVAAERGHDVTLFEKRDQIGGQITIAAKAPQRDQIAGITRWYQLELARLKVDLRLGTAADVAAIQDLRPDVIVLAVGGHSFLEQNEHWGAAEGLVVSSWDVLDGKVAPGKNVLVYDTICEFTGMSVADFIADKGSQVEIVTDDIKPGVAMGGTTFPTYYRSMYPKEVIMTGDMMLEKVYREGDKLVAVLENEYTGAKEERVVDQVVVENGVRPDEELYYALKEGSRNKGQIDVEALFAIKPQPILSQPGEGYLLYRIGDCVAQRNVHAAIYDALRLCKDF

SEQ ID NO: 8925 - protein, 362 aa, Pisum sativum
MGATTTDSVPLLTPYNMGKFKLSHRVVMAPLTRTRSYNNVPQPHAILYYSQRASQGGLLIAEATGVSDTAQGLPDTPGIWTKQQVEAWKPIVDAVHAKGAIFFCQIWHVGRVSNSSYQPNGQAPISSTDKAITSNDQQQFTAPRRLRTDEIPNIVNDFKLAARNAIEAGFDGVEIHGAHGYLLDQFMKDKVNDRTDEYGGSLENRCRFPLEVVEAVVNEIGAERVGIRLSPFAEFAESGDSNPNALGLYMANALNKYNILYCHMVEPRIIDTFDPVETPHSLEPMRKAFNGTFMVAGGYNRQDGIKAIAENRADLVVYGRWFISNPDLPKRFALNAPLNKYNRETFYSSEPVIGYTDYPFLE

SEQ ID NO: 8926 - protein, 394 aa, Unknown
  Pelargonium x hortorum
YFDGWKAYDRDPFHPSQNPNGVIQMGLAENQLSSDLIEDWVRSNPEASICTLEGVGKFKDVANFQDYHGLLEFRHAVAKFMSRGRGGKVTFDPHRVVMSAGATGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFVAPEFVSVSEILQEMDDTTCNPDLIHIVYSLSKDLGMPGFRVGIVYSFNDDVVSCARKMSSFGLVSTQTQHLLAAMLSDDVFVERFLAETRRRLGRRHGVFTKGLEELGIGCLKSNAGLYFWMDLRKLLEEETFEAEMVLWKVIINEVKLNVLLGSSFHCVGPGWFRVCFANMD

SEQ ID NO: 8927 - protein, 207 aa, Pongamiopsis amygdalina
RVMAYKFHEDDHGEVIAEVKKPGLEPYLGLHYPATDIPQATRFLFMKNKVRMIVDCRAKHVNVLQDKKVPFDLTLCGSTLRAPHSCHLQYMENMNCSASLVMAVVVNDNDEDGDSDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 8928 - protein, 480 aa, Oryza sativa
MPSHQPVAGMQAIDPDYVKQPSSMASTSEPNRNPKYDPKKPHITDLPITRSNWYKHVNWLNVIFIIGMPLAGCIAAFWTPLQWKTAVWAVVYYFWTGLGITAGYHRLWAHKSYNASLPLRIFLAAVGAGAVEDSIRWRSRDHRAHHRYTDTNKDPYSVRKGLLYSHLGWMVMKQNPKRIGRTDITDLNEDPVVVWQHKNYIKSVVFMGLVSPTLVSGLFWGDWMGGYIYAGILRIFFVQQATFCVNSLAHWLGEQPFDDRNSPRDHVITALVTLGEGYHNFHHEFPSDYRNAIEWHQYDPTKWSIWLWSKLGLASNLKQFRSNEIEKGRVQQLQKKIDQKRAKLDWGVPLDQLPVIEWDDYVEQAKNGRGLIAVAGVVHDVTDFINEHPGGKTLIKSGIGKDATAMFNGGVYFHSNAGHNLLSTMRVGVIRGGCEVEIWKRAQRENKDVGLVKDNQGNPIIRAGNQITKVAQPIESASAA

SEQ ID NO: 8929 - protein, 362 aa, Pisum sativum
MGATTTDSVPLVTPYNMGKFKLSHRVVMAPLTRTRSYNNVPQPHAILYYSQRASQGGLLIAEATGVSDTAQGYPDTPGIWTKQQVEAWKPIVDAVHAKGSIFFCQIWHVGRVSNSIYQPNGQAPISSTDKSITSNDQQQFTAPRRLRTDEIPDIVNHFKLAARNAIEAGFDGVEIHGAHGYLLDQFMKDKVNDRTDEYGGSLENRCRFTLEVVEAVVNEIGAERVGIRLSPFAEFAESGDSNPNALGLYMVNALNKYNILYCHMVEPRLIQTFDPVETPHSLEPMRKAFNGTFMVAGGYNRQDGINAIDENRADLVVYGRLFISNPDLPKRFALNAPLNKYNRETFYSSDPVLGYTDYPFLE

SEQ ID NO: 8930 - protein, 145 aa, Pongamiopsis amygdalina
VMAYKFHEDDHGEVIAEITKPGLEPYLGLHYPATDIPQAARFLFMKNKVRMIVDCHAKHVKVLQDEKLPFDLTLCGSTLRAPHSCHLQYMANMDSIASLVMAVVVNDNEEDGDSCDAVQPQKRKRLWGLVVCHNTTPRFVPFPLR

SEQ ID NO: 8931 - protein, 326 aa, Catharanthus roseus
MDASALDGIINRLLEVRGRPGKQVQLSESEIRHLCLKSKEIFMEQPNLLELEAPVKICGDIHGQYSDLLRLFEYGGLPPNSNYLFLGDYVDRGKQSLETICLLLAYKIKYPENFFLLRGNHECASVNRIYGFYGECKRRFNVRLWKVFTDCFNCLPVAALIEEKILCMHGGLSPDLHSLDQIRNLPRPTDVPETGLLCDLLWSDPSKDVKGWGLNDRGVSYTFGPDKVKEFLQKHDLDLICRAHQVVEDGYEFFADRQLVTIFSAPNYCGEFDNAGAMMSVDETLMCSFQILNPAEKKAKFGFGSNTTVKTGTSPAKVKSFLGKVG

SEQ ID NO: 8932 - protein, 151 aa, Pongamiopsis amygdalina
RVMAYKFHEDDHGEVIAEVKKPGLEPYLGLHYPATDIPQAARFLFMKNKVRMIVDCRAKHVNVLQDKKVPFDLTLCGSTLRAPHSCHLQYMANMDSIASLVMAVVVNDNEEDGDSSDAVQPQKRKRLWGLVVCHNTTPRFVPFPLRYACEF

SEQ ID NO: 8933 - protein, 170 aa, Callerya megasperma
QATRFLFMKNKVRMIVDCRAKHVKVLQDKKFPFDLTFCGTTLRAPHSCHLQYMENMNAIASLVLAVVVNDNDGYEDSSDDVQPQKRKRLWGLVVCHHITPRFVPFPLRYACEFLAQVFAIHVSKEIELEYQIIEKNILRTQTLLCDMLMRDAPLGIVSQSPNIMDLVKCD

SEQ ID NO: 8934 - protein, 566 aa, Zea mays
MAPLLAAAMNHAAAHPGLRSHLVGPNNESFSRHHLPSSSPQSSKRRCNLSFTPRSARVGSQNGVQMLSPSEIPQRDWFPSDFTFGAATSAYQIEGAWNEDGKGESNWDHFCHNHPERILDGSNSDIGANSYHMYKTDVRLLKEMGMDAYRFSISWPRILPNGTKEGGINPDGIKYYRNLINLLLENGIEPYVTIFHWDVPQALEEKYGGFLDKSHKSIVEDYTYFAKVCFDNFGDKVKNWLTFNESQTFTSFSYGTGVFAPGRCSPGLDCAYPTGNSLVEPYTAGHNILLAHAEAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEDALNDYKRLDYIQRHIATLKESIDLGSNVQGYFAWSLLDNFEWFAGFTERYGIVYVDRNNNCTRYMKESAKWLKQFNAAKKPSKKILTPA

SEQ ID NO: 8935 - protein, 595 aa, Oryza sativa
PRITLYSLVTAVFSDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 8936 - protein, 474 aa, Campylobacter jejuni
MKKLTNDFGNIIADNQNSLSAGAKGPLLMQDYLLLEKLAHQNRERIPERTVHAKGSGAYGEIKITADLSAYTKAKIFQKGEVTPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSFVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIAASMEGVDEKIITRALKHFEKISPDYAKGIKKALEK

SEQ ID NO: 8937 - protein, 96 aa, Ginkgo biloba
LDMPGLKSNDIKVQVENENVLNITGERRRDEKADADAKYIRMERRVGKFMRQFTLPSDANLEGISATCYDGVLTVTVPKIPPPEPKKPKTIEVIAS

SEQ ID NO: 8938 - protein, 275 aa, Bacillus cereus
MHIPTTTLHNGVKMPMIGLGVYKAKEGDEVKQAVKTALEVGYRSIDTATVYENESGVGEAVRESGIPREEIFITTKVWNDDQGYEETLEAFEKSLKKLQMDYVDLYLIHWPIRGKYVDTYRALEKLYEEGKVRAIGVSNFHKHHLELLLPNCKVKPMVNQVELHPMLTQFELRNFCQGEQIQMEAWSPLMRGGEVFQHPIIQAIATKYEKTPAQVILRWDIQSGVVTIPKSVTPSRIQENFSIFDFSLTEEEMTQINTLNRNLHVGTNPDKYDTL

SEQ ID NO: 8939 - protein, 142 aa, Streptococcus thermophilus
MLNKIQQRNSDTYSMTPFDFFEDFSRNLFNDLRSNLIKTDIHETDNEYIVEAELPGISKDNIQVTYEDGVLTISGQQQIDTVDEDKKGKLIRSERSLTSVRRQYLLENVKEDEIKASYSDGILKVTLPKDSNKEIKKSIPIE

SEQ ID NO: 8940 - protein, 518 aa, Zea mays; identical to SEQ ID NO: 162

SEQ ID NO: 8941 - protein, 482 aa, Unknown
  Pelargonium x hortorum
MENKSKQLLSKIATNDGHGENSPYFDGWKAYDRDPFHPSQNPNGVIQMGLAENQLSSDLIEDWVRSNPEASICTLEGVGKFKDVANFQDYHGLLEFRHAVAKFMSRGRGGKVTFDPDRVVMSGGATGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFVAPEFVSVSEILQEMDDTTCNPDLIHIVYSLSKDLGMPGFRVGIVYSFNDDVVSCARKMSSFGLVSTQTQHLLAAMLSDDVFVERFLAERRRLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSTHSPLVRART

SEQ ID NO: 8942 - protein, 447 aa, Wolinella succinogenes
MKSLIWFRRDLRLEDNRTFEQASGEVLPLFIFDSHLLSPLPKEDRRVGYIYGEVMRLKSELRARGLDLAIFYGEPLKILSRLKEQGFSRLFASQDYDSYALSRDEAARELLDCRFVLDNYLFDPNEVLKKEGSPYTIFSAYYNQSLKILSEGHYAKGLDLPKKLAPYPIPAPPSLESMGFSPLPLLESLKILPQKRLEEFSSKITRYALDRDSLEAEATSGLSLFLRFGTLGVREVIRRLKVWQEEGIKVAPFYRQILWREFYAMLLYHFPHSEREDFKPMQMRWSESQERLERWQKGECGVPLVDAGMRELNHTGFMHNRARMVCASFLTKNLHLHWSWGERYFASKLLDYDVAQNAGNWQWCAGSGADAQPFFRIFNPYTQSLKFDPKGEYVKRWIPELRGISTQNWSSEERWEGLKERYLAPIVSAKRSAQEAKAMQNTLRVSS

SEQ ID NO: 8943 - protein, 230 aa, Magnaporthe grisea
MASSSTPPTPLLYTILTECTTSASSQTSSLASLVLPKITHTSPQKLTYTHGAHHIHYIAEAPSDHGPHAASAGGLTFLVIADSSVGRSVPFGYLFEIRRRFLEEYPPGSTDFADQPNYGAASFNGELRRLMVEIGSTRQGRDDAVQNAQREIDDVRGIMTRNIEGLLERGERIDLLVDKTDRLGGSAREFRVRSRGLKRQMWWKNVKLMGLLGLVMFLILLTIIIAVKNS

SEQ ID NO: 8944 - protein, 171 aa, Callerya australis
PQATRFLFMRNKVRIIVDCRAKHVKVLQDKKIPFDLTFCGSTLRAPHSCHLQYMENMDASASLVLAVVDNDNDEYEDSSDDVQPQKRKRLWGLVVCHHISPRFVPFPLRYACEFLAQVFAIHVSKEIELDYQIIEKNILRTQTLLCDMLMRDAPLGIVSQSPNIMDLVKCD

SEQ ID NO: 8945 - protein, 484 aa, Proteus mirabilis
MEKKKLTTAAGAPVVDNNNVITAGPRGPMLLQDVWFLEKLAHFDREVIPERRZHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 8946 - protein, 285 aa, Yersinia pestis
MKTAKLFSPLKVGALTLPNRVFMAPLTRLRSIEPGDIPTPLMAEYYRQRASAGLIITEATQISFQAKGYAGAPGLHTQEQLNAWKKVTQGVHNEGGHIAVQLWHVGRISHNSLQPGQQAPVAPSAIAADTRTTVRDETGAWVRVPCSTPRALETEEIPGIINDFRQATANAREAGFDYIELHAAHGYLLHQFMSPASNQRTDQYGGSIENRTRLTLEVVDATAAEWGADRIGIRISPLGPFNGLDNGEDQEEAALYLIGPNAESGATDMTSFICRYCEPGRKPKM

SEQ ID NO: 8947 - protein, 245 aa, Zea mays
MAMLSTSWASSPISVSRTTRSPSLRDRYKALKDHRWELCTRFIDLKDASSGFETPGACYCSLVGDFNQCPQPKTVPGKEYNYVDDYDKGDNGVYAEEIMRRMKEEYWEPGEIRTCSCSWATSALPYAEGKQTYAVHWEPPPEEIYKWRFGRPKVKGSLRIYECHVGISGSEQKVSSFQEFTSKVLPHIKKAGYNAVQLTGVVLHKDYSSIGYKMNWLGYRFMMALMAVTSKEGKRTSRVSGHRDV

SEQ ID NO: 8948 - protein, 212 aa, Haemophilus influenzae
MNIEIIPVTAFQQNCSLIWDDEKNAAIIDPGGEAERLIQRIEELDLNLKVILITHGHLDHVGAAMQLKQHFGVEIWGSNEKDKFLFESLPEQAQRFGLPNIDAFLPDRWFNQEGEILKLDGFNFEILHLPGHTPGHIGFIEHEKKVAFTGDVLFQGGIGRTDFPRGDYETLISSIRTKLLPLNDDIIIIAGHGSYTTIGQEKRSNPFLNPKS

SEQ ID NO: 8949 - protein, 160 aa, Millettia thonningii
KVRMIVDCHAKHVKVLQDEKLPFDLTLCGSTLRAPHSCHLQYMANMDSIASLVMAVVVNDNEEDGESSDAVQPQKRKRLWGLVVCHNTTPRFVPFPLRYACEFLAQVFAIHVNKEIELEFQIIEKNILRTQTLLCDMLMRDAPLGIVSQSPNIMDLVKCD

SEQ ID NO: 8950 - protein, 822 aa, Arabidopsis thaliana
MGLIKNTVHYCCVSRDNQILYSYNGGDQTNESLAALCLEKSPPFHTWYFETIGKRRFGFLIGDGFVYFAIVDEVLKRSSVLKFLEHLRDEFKKAARENSRGSFTAMIGSINVEDQLVPVVTRLIASLERVAESSSNNELKSSNLGEQSEGSNSTKAPLLGRLSKQEKKKGKDHVIELEEHRKSNDRGNITDDSAGAGTSLEKECVSSSGRSVTQSFEWKWRRPINRLRETNLPKEKNQQNQNKATVSLSLSLSLTSSPPFSPLKPDQKPSFIRALLGQQMFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNVMRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 8951 - protein, 280 aa, Crocosphaera watsonii
MSKSPTLLSPCQVGNITLKNRVVMAPLTRSRAGEERMPNDLMKQYYSQRKSAGLIISEATVISPQGCGWLNSPGIYSDAQMKAWQPITQALHETETPIFLQLWHCGRASHSSFQENNQLPVSASAVKPNGDYIHTPIGKQSYKTPRALETEEIPPIVEDYRLAAERAKDAGFDGVEIHAANGYLIDQFLQSKTNQRTDKYGGSIENRYRFLKEIIEAVLTVFSAGQIGVRLSPNGVFNDMGCPEYRELFIYVAQQLNSYNLAYLHLLDGLGFGFHELGVQ

SEQ ID NO: 8952 - protein, 276 aa, Ralstonia solanacearum
MTDTQPAVTLGDGARMPQLGLGLWRTPAGETAGLVRTAIEAGYRLVDTAAAYGNERGVGEGVRAAGAEPAVFVTTKLWNEDQGYDRTLRAFDESLRCLGLPAIDLYLIHWPAPSRGRYVESWRALIRLRDEGRARSIGVSNFGAEHLARIIDETGEAPAVNQIELHPWFQQRALRAFHARHGVRTESWSPLGQGGLLHDLTVREIAARHGKTPAQVVIRWHLDNGLIVIPKSAHPDRIRENIAVFDFCLTPADQAAIAGLDRADGRIGPDPVAAGF

SEQ ID NO: 8953 - protein, 220 aa, Eucalyptus gunnii
MNPFSSHSHPNSCRFNFAEPPSDSRSATALGNFSHKEVLLASHHPKKRAGRKKFRETRHPVYRGVRLRDSGKWVCEVREPIKKSRIWLGTFPTVEMAARAHDVAALALRGRSACLNFADSAWRLPVPASADTKEIQKAAARAAEAFQSVESEDVMSGDEKKLRSEEGVFYDEEDIFGMPGLLADMAEGMLLSPPKWGGDIYGGEDEGNLGAHTSLWSYSI

SEQ ID NO: 8954 - protein, 531 aa, Streptococcus ratti
MAKDIKFSADARSAMVRGVDTLADTVKVTLGPKGRNVVLEKSFGSPLITNDGVTIAKEIELEDHFENMGAKLVSEVASKTNDIAGDGTTTATVLTQAIVREGLKNVTAGANPIGIRRGIETAVATAVDGLKAIAQPVSGKEAIAQVAAVSSRSEKVGEYISEAMEKVGNDGVITIEESRGMETELDVVEGMQFDRGYLSQYMVTDNEKMVADLENPYILITDKKISNIQDILPLLEEVLKTNRPLLIIADDVDGEALPTLVLNKIRGTFNVVAVKAPGFGDRRKAMLEDIAILTGGTVITEDLGLELKNATMDALGQAARVTIDKDTTVIVEGSGSKEAIENRVALIKSQIETTTSDFDREKLQERLAKLSGGVAVIKVGAATETELKEMKLRIEDALNATRAAVEEGIVSGGGTALINVIEKVAALDLEDDAATGRNIVLRALEEPVRQIAKNAGYEGSVVIDKLKNSPVGTGFNAANGEWVDMIKEGIIDPVKVTRSALQNAASVASLILTTEAVVADHPAPEAPAAPA

SEQ ID NO: 8955 - protein, 423 aa, Candida albicans
MMNIDQHHQLQQQHQQQMLQQQAQAQAQAQAQAQQQQQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 8956 - protein, 224 aa, Eucalyptus gunnii
MNSSSYISHPNSFSFDFAEPPFSLLLSHDRSAAPGNFSGEEVRLASDHPKKPAGRKKFRETRHPVYRGVRLRDSGKWVCEVREPRKKSRIWLGTFPTADMAARAHDVAALALRGQSACLNFADSAWRLPVPASPNTKDIQKAAAKAAEAFQLVESEDVMSGNEKKLHSEEGVLYDEEDIFGMPGLLANMAEGMLLSPPECSGDIYAGLDDGNLDAYTSLWSYSM

SEQ ID NO: 8957 - protein, 461 aa, Unknown
  uncultured epsilon proteobacterium
MLFKQLFTIISSIKIKHGYIMKNKKFITLGFASASIAIALLFSTNVFASSANSEATKEASRLQSLAKFTKVISIVEQYNVDDITIEELMDKALEGMLSNLDAHSNYLKQKDYKQLKVQTDGEFGGLGITVGVRDGALTVIAPIEGTPADKAGLQSADIILKINDESTLNMTIDEAVAIMRGKVGEPIDLMIVREGELKPLTIHIVRGIITIQSVYAKTIEDDILYIRVTSFDKKVAEDVTKEIKKRKATTKGIILDLRNNPGGLLDQAVDLVDIFVDKGDIVSQKGRKEADAKTYTASKNKTVTNVPLVVLINGGSASASEIVSGSLQDHKRAILLGQNTFGKGSVQVVLPITEDEAIKLTIARYYLPSGRTIQAVGVKPDIEVFPGEVNTKKNAFSIKESDLKKHLEEELVKVDGNETIKEEKEALEEAKKGIITPEMMNKDIQLKEGVDIIKALIIIKG

SEQ ID NO: 8958 - protein, 525 aa, Streptococcus sobrinus
MAKDIKFSADARSAMVRGVDVLADTVKVTLGPKGRNVVLEKSFGSPLITNDGVTIAKEIELEDHFENMGAKLVSEVASKTNDIAGDGTTTATVLTQAIVREGLKNVTAGANPIGIRRGIERAVSTAVDELKAIAQPVANKEAIAQVAAVSSRSEKVGEYISEAMEKVGNDGVITIEESRGMATELDVVEGMQFDRGYLSQYMVTDNEKMVADLDNPYILITDKKISNIQDVLPLLEEVLKTSRPLLIIADDVDGEALPTLVLNKIRGTFNVVAVKAPGFGDRRKAMLEDIAILTGGTVITEDLGLELKDASIASLGQAAKITIDKDSTVIVEGAGSADAIAERVAVIKSQLESTTSEFDREKLQERLAKLSGGVAVIKVGAATETELKEMKLRIEDALNATRAAVEEGIVAGGGTALVNVIEKVTALDLAGDQATGRNIVLRALEEPVRQIARNAGYEGSVIIEKLKASKSGTGFNAADGSWVDMVEAGIIDPVKVSRSALQNAASVASLILTTEAVVADHPEEN

SEQ ID NO: 8959 - protein, 528 aa, Streptococcus mutans
MAKDIKFSADARSSMVRGVDILADTVKVTLGPKGRNVVLEKSFGSPLITNDGVTIAKEIELEDHFENMGAKLVSEVASKTNDIAGDGTTTATVLTQAIVREGLKNVTAGANPIGIRRGIETAVATAVDELKAIAQPVSGKEAIAQVAAVSSRSEKVGEYVSEAMEKVGNDGVITIEESRGMETELDVVEGMQFDRGYLSQYMVTDNEKMVADLENPYLLITDKKISNIQDVLPLLEEVLKTNRPLLIIADDVDGEALPTLVLNKIRGTFNVVAVKAPGFGDRRKAMLEDIAVLTGGTVITEDLGLELKDTTIDALGQAARVTVDKDSTVIVEGSGGKEAVANRVNLIKSQIETATSDFDREKLQERLAKLSGGVAVIKVGAATETELKEMKLRIEDALNATRAAVEEGIVAGGGTALINVIEKVAALDLTDDAATGRNLVLRALEEPVRQIAKNAGYEGSVIIDKLKNSSAGTGFNAANGEWVDMIDAGIIDPVKVTRSALQNAASVASLILTTEAVVADHPAPEAPA

SEQ ID NO: 8960 - protein, 507 aa, Candida glabrata
MSANPTNTSDVRGDRVVTNSTGYPYNDPFATQRVGQHGPLLMQDANLIDSLAHFNRERIPERNPHAHGSGAFGYFEVTDDITDICGSAMFSEIGKRTRFLTRFSTVGGEKGSADTARDPRGFATKFYTEEGNLDWVYNNTPIFFIRDPSKFPHFIHTQKRNPQTNLKDPNMFWDYLTTPENQVAVHQLMILFSDRGTPASYRHMNGYSGHTYKWSNKKGEWHYVQVHILTDQGIKNLTNDEAVEIAGKNPDYCQQDLYENIAKGNYPSWTVYIQTMTEEQAKKLPFSVFDLTKVWPHKDFPLRRVGKMVMNENPLNYFASIEQAAFSPANTVPYQEPSADPVLQSRLFAYADAHRYRLGANFHQIPVNCPYASKFFNPVIRDGPMNVDGNFGNEPNYYASNKQYQIPNQDRPIQQHQEVWNGPAQPFHWATSPGDIDFVQARDLYKVLGKQKDQQEHLAYNIGTHVAGADPEIQQRVIDMFSRVDEGLGANIRKEIEKNASAPTAKI

SEQ ID NO: 8961 - protein, 452 aa, Streptomyces avermitilis
MTIDLAALPHDFLWGTATAAYQIEGAVAEDGRSPSIWDTFSHTPGKIDNNDHGDVACDHYHRWREDIGLMKQLGTNAYRLSVAWPRVIPGGDGPVNAKGLAFYDELVDGLLEAGITPSVTLYHWDLPQVLQDRGGWPERATAEHFAAYAAVVAERLGDRVTHWATLNEPLCSAWIGHLEGKMAPGLTDLTAAIRASYHLLLGHGLAAQAIRAAAPAAEVGIVNNLSTIHAASDRPEDVAAARRMDGHVNRWWLDPVHGRGFPADMREVYGVELPEQPGDLATIAAPLDWLGLNYYFPATVADDPTGPAPRVRSVRRLGVPRTGMDWEIDATGIETLLLRLTHEYGPRKLYVTENGSAFPDVVRPDGTVDDPERQDYLVRHLAACASAARKGAPLAGYFAWSLLDNFEWAYGYDKRFGLVHVDYRTQVRTIKGTGHRYADIVRTHRGRARRAA

SEQ ID NO: 8962 - protein, 422 aa, Pseudomonas syringae
MTGFLWNVSDNARVTFFFMSIFTRAKQPMCYNGLLDLSVWQVIAVTLAMTHVTIVGVTVYLHRYSAHRSLELNAGLKHFFRFWLWLTTAQNTREWTAIHRKHHAKCETVDDPHSPVVKGLSTVLRKGAELYREEAQNQDTLRIYGKNCPEDWIERNLYSRYKLLGIALMAVIDVALFGALGITVWAVQMMWIPFWAAGVVNGLGHAVGYRNFECRDAATNLVPWGIVIGGEELHNNHHTYPNSAKLSVKPWEFDMGWAWIKLFSFLGLAKVQRVAPIAHRVEGKGHMDMDTAMAILNNRFQIMGQYRKLVIAPLVAQELAKADESVRHQFSRAKRLLSRETSLLDDKHHLRIQTMLEHSHALKVIYEKRLALQQIWVKTSSNGHDMLSAIKEWIHEAEASGIHSLREFADQLKTYSLRPAHA

SEQ ID NO: 8963 - protein, 400 aa, Candida glabrata
MSFTTDFEPVSLKGTNLFKPLKVGNNTVLHRAAFPPLTRMRAESPGNIPNREWSVEYYRQRSQRPGTLVITEGTFPSAQAGGYDNAPGIWSEEQLVEWRKIIDAIHSNKSFAWVQLWALGRLAMPNLLARDGLRFDSATDNYYASPEQEELAKKSNNLQHGLSREDIKQYVNDYVQASKNAISAGADGVEIHSSTGFLLNEFIDPISNHRSDEYGGSIENRARFVLEVVDAVVDAIGAEKTAIRFSPYGNYGGMSGGTDPTIIAQYAYIIGELEKRAKGGKRLAYIHFMEPRVLDPFLPEGESVYNEGTIDFAYSIWKGVIIRTGNYAIHPEVVKDVVNDDRTIIGYGRYFISNPDLVDRLEKGLPLNKYDRSYFYTMTAEGYIDYPTYAEAIKKGWDKK

SEQ ID NO: 8964 - protein, 492 aa, Homogyne alpina
MDPYKQRPASAYNSPFLTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEDWRILDFLSHHPESLNTMTFWLDDIGIPTDYRHMEGSSVNALTLVNKEGKMHYVKFTWKPTCGVKCLMDEEAIKIGGANHSHATQDLYDSIQAGNFPEWKLFLQVIDPDHEDRLDFDPLDGTMTWPDDIIPLQPVGRMVLNKNIDNFFAENEQLALNPGLVVPGIYYSDDKMLQGRIFAYSDTQRHRLGPNYLQLPVNAPKCAHRNNHYDGNMNFMHRDEEVDYFPSRYDRVQHAQKYPISPAKVTGTRDRTVIPKANDFKQPGERYRSWEPDRQERFIIRMVKMLSDPRVTHELRSIWISYWTQADQSLGQKIASRLNVRPNY

SEQ ID NO: 8965 - protein, 470 aa, Staphylococcus aureus
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 8966 - protein, 439 aa, Thermus thermophilus
MKRRAWFMVGLGALLALVYAQLPRPQAETFLQNPNGQALLEVYQRIQQDYLEPLSKEKLDKLLEGAIGGMVQALEDPFTSYSPPQRSTLRQEDLRGEFFGIGATLSAANPDGTGARIEGVMKGLPAQRAGLRAGDVILEVDGEDVTKLPLLDIVAKIRGREGTKVTLKVRREGVPAPLVFELVRERVEIISVSTAKVGDVGYVALETFANFKVEDQLKRAIEELKAQGVKKLIFDLRDNGGGLLDQGCAVASAFLKEGPIVYTRTKNLTRVWCEATGQTLWDGPMVVLVNGNSASASEIVAGALQDYGRAKVIGEKTFGKGVGQTPYTLANGGELTLVTFEWLTPKRRSINKEGITPDIVVKDTRFPTPFSLQGAGAPPGAEIAVTLNGKTVKVKADAEGKFSYAEPQRQRPLPEDRGQAVLDLENDAILKRALEELNR

SEQ ID NO: 8967 - protein, 218 aa, Triticum aestivum
  misc_feature (108)..(108): Xaa can be any naturally occurring amino acid
  misc_feature (132)..(132): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLSAYSDSXRYPGVRQEVAEFIQRRDGYPSDPXLIYLLMVPQRCDQMLNAIIRNKRTGFCPWSTIPVYSAAISFGGSLVPIFEKKLLGLILQSRNWKTRQGNTVHDINQKPSGKAKEKK

SEQ ID NO: 8968 - protein, 162 aa, Unknown
  Frankia sp. CcI3
MAFPVRSSQRPAPVIRWDPFREIEDAWTRMGSLLDEVVGGAEGRPVGLLAAAVIPVDIEETDDAYIVELELPGVRGRDVSIDLQDNELRVTGEIKERERKGVLRRQTRRVGRFEHRIVLPGEVDPESVSASLDDGVLTIRLAKSRKSQPRHIEVTGGSGGGS

SEQ ID NO: 8969 - protein, 484 aa, Oryza sativa
MAAPSVAVDNLNPKVVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 8970 - protein, 429 aa, Zea mays
MAKSKSSAKAGPPLLGKYELGHLLGRGNFAKVYHARCLGGGDPVAVKVLDKAGLAATGMASRLLREVSAMRRLSHPNVLRLHEVLATRSKVYLVMELAPGGDLLSRLASLPSRRLPEHAARRVFLQLASALIYSHARGVFHRDVKPQNVLLDAEGNLKVSDFGLAALPDSVRDDGRLHTACGTPAFAAPEVLRRRAYDGAKADAWSCGVILFVLLAGHLPFDDANIADMCRRAHRREYTVPRWVSQPARRLVARLLDPNPATRLAVAELAGHPWFKRSLSVDSQLGGLLDGQAERELAFQAPPALNAFDIISMSPGLDLSGLFGEGRRRREKRFMTTASPERAVERLAQAGARLGYFIVGKKGAERLPLGVLPGLVAMSMEMSEVSPELMLVELRLEGGHGDEDEAFGWEELRVELGDVVTAWHVSEEG

SEQ ID NO: 8971 - protein, 316 aa, Glycine max
MSDAKERSGFCVWPDARQLCLRKGLLYGFMRLFSIPLKTLRGASRSLRVDQFCSVVNLSSSLQIELVPCLRDNYAYLLHDVDTGTVGVVDPSEAAPIIDALSKKDLNLTYILNTNHHPDHTGGNAELKERYGAKVIGSEIDKERIPGIDIYLSDGDNWMFAGHEVHILATPGHTEAGHVSFYFPGSGAIFTGDTLFSLSCGKLLEGTPEQMLSSLKRIMSLPDDTSIYCGHEYTLNNSKFALSIEPENKELQSYATHVSNLRNKGLPTIPTTLKVEKACNPFLRTWSIEIRQKLNIAATADDAEALGVIRQAKDNF

SEQ ID NO: 8972 - protein, 206 aa, Mundulea sericea
MAYKFHEDDHGEVIAEITKPGLEPYLGLHYPATDIPQASRFLFMKNKVRMIVDCHAKHVKVLQDEKLPFDLTLCGSTLRAPHSCHLQYMANMDSIASLVMAVVVNDNEEDGDSSDAVQPQKRKRLWGLVVCHNTSPRFVPFPLRYACEFLAQVFAIHVNKEIELENQIIEKNILRTQTLLCDMLMRDAPLGIVSQSPNIMDLVKCD

SEQ ID NO: 8973 - protein, 349 aa, Pseudomonas fluorescens
MATIFDPIKLGDLELSNRIIMAPLTRCRADEGRVPNALMAEYYVQRASAGLILSEATSVTPMGVGYPDTPGIWSNDQVRGWTNVTKAVHAAGGKIVLQLWHVGRISHPSYLNGETPVAPSAIQPKGHVSLVRPLADYPTPRALETAEIADIVDAYRVGAENAKAAGFDGVEIHGANGYLLDQFLQSSTNQRTDNYGGSLENRARLLLEVTDAAIEVWGAGRVGVHLAPRADSHDMGDDNLAETFTYVARELGKRGIAFICSREKEGADSLGPQLKEAFGGAYIANERFTKDSANAWLAEGKADAVAFGIPFIANPDLPARLKADAPLNEPHPETFYGKGAVGYLDYPTL

SEQ ID NO: 8974 - protein, 413 aa, Crocosphaera watsonii
MRKRAFWVTLLVIFSLLFNCFAWTPNADAFTENQKLLLQSWRLVNQSYLDDTFNHQNWWLLRQDLLKRSLDNREETYDTIEEMLATLDEPFTRLLRPEQYHNLQVSTAGQLSGVGLQININPDTGNLEVVSPIEGSPADAAGIKARDRILKIDDVDTTTLTLDEAATRMRGPRGTKVYLTILPHKETSDIREVEITRNRISLSPVTASLNQPTPNLPIGYIRLNQFSANAAEEMANAINNLEKEGAEGYILDLRNNPGGLLQAGIEIARLWMDQGTIVYTVNRQGVQDSFSALGTALTDDPLVLLVNQGTASASEILAGALKDNRRATLVGEKTFGKGLIQSLFELPDGAGLAVTVAKYETPNHNDIHKLGIEPDKVVNQEPISYRQIATKDDVQYEAAVELLTGNSVLANAG

SEQ ID NO: 8975 - protein, 526 aa, Streptococcus mutans
MAKDIKFSADARSSMVRGVDILADTVKVTLGPKGRNVVLEKSFGSPLITNDGVTIAKEIELEDHFENMGAKLVSEVASKTNDIAGDGTTTATVLTQAIVREGLKNVTAGANPIGIRRGIETAVATAVDELKAIAQPVSGKEAIAQVAAVSSRSEKVGEYVSEAMEKVGNDGVITIEESRGMETELDVVEGMQFDRGYLSQYMVTDNEKMVADLENPYLLITDKKISNIQDVLPLLEEVLKTNRPLLIIADDVDGEALPTLVLNKIRGTFNVVAVKAPGFGDRRKAMLEDIAVLTGGTVITEDLGLELKDTTIDALGQAARVTVDKDSTVIVEGSGGKEAVANRVNLIKSQIETATSDFDREKLQERLAKLSGGVAVIKVGAATETELKEMKLRIEDALNATRAAVEEGIVAGGGTALINVIEKVAALDLTDDAATGRNLVLRALEEPVRQIAKNAGYEGSVIIDKLKNSSAGTGFNAANGEWVDMIDAGIIDPVKVTRSALQNAASVASLILTTEAVVADHPAPEA

SEQ ID NO: 8976 - protein, 283 aa, Oenococcus oeni
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVEAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKASSLIHQRSNIDIFDFSLTSSEIEQINALNRSDGRVDGQDPNTYEEFD

SEQ ID NO: 8977 - protein, 162 aa, Oryza sativa
  misc_feature (44)..(44): Xaa can be any naturally occurring amino acid
MSLIRRSNVFDPFSLDLWDPFDGFPFGSGGSSSGSIFPCVPARXASSETAAFAGARIDWKETPEAHVFKADVPGLKKEEVKVEVDDGNILQISGERNKEQEEKTDQWHRVERSSGKFLRRFRLPDNAKPEQIKASMENGVLTVTVPKEEAKKPDVKSIQISG

SEQ ID NO: 8978 - protein, 525 aa, Streptococcus sobrinus
MAKDIKFSADARSAMVRGVDVLADTVKVTLGPKGRNVVLEKSFGSPLITNDGVTIAKEIELEDHFENMGAKLVSEVASKTNDIAGDGTTTATVLTQAIVREGLKNVTAGANPIGIRRGIERAVSTAVDELKAIAQPVANKEAIAQVAAVSSRSEKVGEYISEAMEKVGNDGVITIEESRGMATELDVVEGMQFDRGYLSQYMVTDNEKMVADLDNPYILITDKKISNIQDVLPLLEEVLKTSRPLLIIADDVDGEALPTLVLNKIRGTFNVVAVKAPGFGDRRKAMLEDIAILTGGTVITEDLGLELKNASIASLGQAAKITIDKDSTVIVEGAGSADAIAERVAVIKSQLESTTSEFDREKLQERLAKLSGGVAVIKVGAATETELKEMKLRIEDALNATRAAVEEGIVAGGGTALVNVIEKVTALDLAGDQATGRNIVLRALEEPVRQIARNAGYEGSVIIEKLKASKSGTGFNAADGSWVDMVEAGIIDPVKVSRSALQNAASVASLILTTEAVVADHPEEN

SEQ ID NO: 8979 - protein, 942 aa, Rhodopirellula baltica
MNSTIASNPTSSRIVSITSLPPKVLATDLDGTFLPLDGDDAAVASMKQIREQLEAIDVPLVFVTGRHFDSVRDAIGEFNLPKPQWILCDVGVSIYKADGEGGYIRESAYEQILDEVLGDIDIQKHRLAIGELENFTLQESYKQGRHKWSYYVPADQLEACHQAVEAYLKLHELPCSIVSSIDPFNNDGLVDVLPHGASKAFALHWWCDQHELQPEQIVFCGDSGNDTAALIAGYRSVVVGNADRKIARKVADAHQAAGWVDRLKLARGTSTSGVLEGARWFGLFENSIEETSIEATSPLNATDLPESIPWGARLIGANRAEFTLWAPKQKQVVLELMPDRLVRMQREDRGFHRCIVDGVVDGTRYQYRFVRDEHVAAFADPNTELSVDMLLHALPDPASRYQPEGVHGPSSIVDAQFPFQATADSAADELDELIIYEMHLGTFTEQGTYLSAIERLDELVDLGITAIELMPIAACAGHWNWGYDGTHWFAPMTAFGSPNEFRQFVDAAHIRGLLVMVDVVYNHFGSEGNYWTEFGPYTSRKHNTVWGAAPNFDDPKRGDLVRRFVIDNAIMWLKEYNLDGFRVDAIHCMKDDSAKHITTQMSEEIRRWSDKAGRRVWLIAETNVYDAAMVKPLSEGGTGFDAQWSDDFVHSMFATVRPGEQLTQRIYSPGSDLEQTLRRGFVFAGDVRGDRGREAEPTLDTDGMLKRIDTRSSIVCIQNHDFIGNHPTGMRLHQLTSPETQAAAVTLAMLLPSIPMLFMGEEFASPNPFRFFVDFGDPRLQRAVVRGRKREYPQHDWSDGVLPTDEEAMRSSVIGSVELGSETMRNWYKTLISIRKQFVGSGLLSPQNFSVDVNCEANLYSLSYQTPNEALQVMVRLSPLTEDDSVDEPSAIDPLPSRPEGASPDSWRLLADSMEAFGERLTEGLLPNHARICYFEHDEPTA

SEQ ID NO: 8980 - protein, 526 aa, Streptococcus downei
MAKDIKFSADARSAMVRGVDVLADTVKVTLGPKGRNVVLEKSFGSPLITNDGVTIAKEIELEDHFENMGAKLVSEVASKTNDIAGDGTTTATVLTQAIVREGLKNVTAGANPIGIRRGIERAVSTAVDELKAIAQPVANKEAIAQVAAVSSRSEKVGEYISEAMEKVGNDGVITIEESRGMATELDVVEGMQFDRGYLSQYMVTDNEKMVADLDNPYILITDKKISNIQDVLPLLEEVLKTSRPLLIIADDVAGEALPTLVLNKIRGTFNVVAVKAPGFGDRRKAMLEDIAILTGGTVITEDLGLELKDATIASLGQAAKITIDKDSTVIVEGAGSADTIAERVAVIKSQLESTTSEFDREKLQERLAKLSGGVAVIKVGAATETELKEMKLRIEDALNATRAAVEEGIVAGGGTALVNVIEKVAALDLDGDQATGRNIVLRALEEPVRQIARNAGYEGSVIIEKLKASQAGTGFNAADGSWVDMVEAGIIDPVKVSRSALQNAASVASLILTTEAVVADHPEEKA

SEQ ID NO: 8981 - protein, 507 aa, Pichia angusta
MSNPPVFTTSQGCPVSDPFTTQRIPLDSTGYKYAPPIGPLLLQDFKLIDTLSHFDRERIPERVVHAKGAGAYGVFEVTDDITDVCSAKFLDTVGKKTRIFTRFSTVGGEKGSADTARDPRGFATKFYTEDGNLDLVYNNTPIFFIRDPIKFPHFIHTQKRNPATNLKDPNMFWDYLTANDESLHQVMYLFSNRGTPASYRTMNGYSGHTYKWYNSKGEWVYVQVHFIANQGVHNLLDEEAGRLAGEDPDHSTRDLWEAIEKGDYPSWECYIQTMTLEQSKKLPFSVFDLTKVWPHKDFPLRHFGRFTLNENPKNYYAETEQIAFSPSHTVPGMEPSNDPVLQSRLFSYPDTHRHRLGPNYHQIPVNCPLKSGSFNPINRDGPMCVDGNLGGTPNYANAYNCPIQYAVSPKASGNKPDEKYTGEVVPYHWEHTDYDYFQPKMFWKVLGRTPGEQESLVKNVANHVSAADEFIQDRVYEYFSKAEPIIGDLIRKKVQELKRKASSPSKI

SEQ ID NO: 8982 - protein, 351 aa, Rubrivivax gelatinosus
MDPIELEQWLSAHPPALADVIRHVAAACARISRAAARAPLAGQLGGAGSLNSQGEPQQRLDVLADACVSQALSACTHVAGWVSEEHADVTVSPEHGSGGAYLVVFDPLDGSSNVETNVAIGSIFSVLPHLFRGTPASAAAFMQPGRRQVAAGYAIYGPSTVLVLSLGQGVHMFTLDPDAPGDAARWVLTRADVEVPVSTTEFAINASNQRFWEKPVQRYVAECLAGQSGPRGRDFNMRWVASLVAEVHRILTRGGVFLYPRDSREPFRPGRLRLLYEAAPMAWLMEQAGAAATTGTGPLLELVPDALHHKVPVILGSRDEVERIVTYHEDPSANVSWQLFKTRSLFIQPQA

SEQ ID NO: 8983 - protein, 710 aa, Saccharomyces cerevisiae
MGNSGSKQHTKHNSKKDDHDGDRKKTLDLPPLTKSDTTHSLKSSRSLRSLRSKRSEASLASNVQAQTQPLSRRSSTLGNGNRNHRRSNNAPITPPNNHYLTSHPSSSRRLSSSSRRSSMGNNNNSELPPSMIQMEPKSPILKNSTSMHSTSSFNSYENALTDDDDDRGDDGGESPSMAKVTRINTSSSADRGSKRTPLRRHNSLQPEKGVTGFSSTSSKLRRRSDNTLPATYPLNAEAGGNGSDYFSNRSNSHASSRKSSFGSTGNTAYSTPLHSPALRKMSSRDNDDSGDNVNGRGTSPIPNLNIDKPSPSASSASKREYLSAYPTLAHRDSSSSLSPRGKGQRSSSSSSSSQRIYVSPPSPTGDFVHGSCADGDNGSRTNTMVEMKRKKPVRPVDIDEIIQRLLDAGYAAKRTKNVCLKNSEIIQICHKARELFLAQPALLELSPSVKIVGDVHGQYADLLRLFTKCGFPPMANYLFLGDYVDRGKQSLETILLLLCYKIKYPENFFLLRGNHECANVTRVYGFYDECKRRCNIKIWKTFVDTFNTLPLAAIVTGKIFCVHGGLSPVLNSMDEIRHVSRPTDVPDFGLINDLLWSDPTDSSNEWEDNERGVSFCYNKVAINKFLNKFGFDLVCRAHMVVEDGYEFFNDRSLVTVFSAPNYCGEFDNWGAVMTVSEGLLCSFELLDPLDSTALKQVMKKGRQERKLANR

SEQ ID NO: 8984 - protein, 442 aa, Mycobacterium avium
MPALLWFRRDLRLHDHPALSAAADSDEVLACFVLDPRLQRSSGPRRLQFLGDSLRVLRDELDGRLLVTRGRPDIRIPEIAKAIGASSVHVSEDFTPFGKRRDARVRAALASVPLVATGSPYLVAPGRVTKPDGSPYQVFTPFLRRWRDTGWRPPVKTGAASARWLDPARLGITDCEIPDPGATLDLAAGEEAARNKWKSFVDNGLANYADDRHRPDIEGTSRMSAHLKFGTIHPRTLVADLDLRAAAARAYLRELAFRDFYADVLHHRPASAWRNWNSAFDAIRTDTGAEAGRRFAAWKAGETGFPFVDAGMRQLRQTGFMHNRVRMTVASFLVKDLHLPWQWGAHWFLQQLVDGDLANNQHGWQWCAGCGTDAAPYFRVFNPAAQGEKFDPSGDYIRRWVPELRCADDPHLRTGERPPGYPAPIVDHATERAEALRRYRSM

SEQ ID NO: 8985 - protein, 755 aa, Vibrio parahaemolyticus
MSSQRWLWRNQHSVQTNIGSREKDLKITKTKKIKKKHERAYELLAEAAYSDPFAALGPFIDDGEGSLRVWMPGANKVELLVNGEPRVALERDGDSGFILKEQRDLHLTHYRLAVDWNGVEQIIDDPYQYHNIYQEYEHLHTPKDMYHYMGAHFVTLERGGENISGVRFLVYAPHASAVSLVGCFNQWDGRRHPMQRLDYGIWGLFIPGLEEGVQYKFELKGPNGEGLPHKQDPWGFYSEQYPSFASITYDHKRYQWQDAKWQNRAVTQKRDEALSFYELHAGSWKRDGKGDFLNYRELAEQLVPYLVDMGYTHVELMPVSEHPFYGSWGYQPVGLFAPTSRYGSPDDFKFFVDACHQAGIGVVLDWVPAHFPSDDHGLANFDGTPLFHDPDPRRGWHQDWNSYIYDLGREHVRRFLVSNALYWFEQFHIDGIRVDAVASMLYLDYSRSHDQWVPNVDGGNENYDAIATLKWMNEEVYKHFPNAMTIAEESTAFPGVSAPTFMGGLGFGFKWNMGWMHDSLSYVKEDPVHRKYHHNTITFPLVYAHSENYVLSLSHDEVVYGKGSIHNKMPGDEWQQTANLRAYYGYMYGQPGKKLNFMGAEIGQTAEWNHDDQLQWFLLEYERHQGVQKLMRDLNHLYRNEAAMHDQDCVPAGFEWRLQDEADASILAHERISKEGERILIITNFTPVPHERFRLGVPNVGQYELLLNTDDSKYGGSDFKVLTSVKTEKVESESLPQSLELRLPPLSTVFYKLHK

SEQ ID NO: 8986 - protein, 401 aa, Pyrococcus horikoshii
MTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 8987 - protein, 196 aa, Selaginella lepidophylla
MADTEFFTEYGEASRYKIQEVIGKGSYGVVCSAIDTHTGEKVAIKKINDIFEHVSDATRILREIKLLRLLRHPDIVEIKHIMLPPSRREFKDIYVVFELMESDLHQVIKANDDLTPEHYQFFLYQLLRALKYIHTGNVFHRDLKPKNILANAYCKLKICDFGLARVAFNDAPTAIFWTDYVATRWYRAPELCGSFF

SEQ ID NO: 8988 - protein, 372 aa, Methylococcus capsulatus
MTNPLFQPFRLGPHTLKNRMVMAPLTRSRAGQPGNVPTALNAEYYRQRASAGLIISEATQVSPQGQGYAWTPGIHSAEQVAGWRLVADAVHGAGGLMFMQLWHVGRVSHPALQPGGALPVAPSAIAPTGMAFIVNAEGQGELVPFVTPRVLELDEIPGIVGQYRDGARNAMAAGMDGVEVHAANGYLLDQFLNSSSNHRRDAYGGSPENRARLLMEVLEAVCGVWGADRVGVRLSPLGTFNDMGDADPEATFGYVAERLNDFGLAYLHVVEPFMAGNAPAATPDPRGEAIMAMIRMSFRGPLIVCGGYDQAKAVACLESGRADLVAFGRLFIANPDLPERFRRGAALNGWNEATFYGGGAEGYTDYPSLTDA

SEQ ID NO: 8989 - protein, 282 aa, Staphylococcus aureus
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYLDLVLIHQPYNDVYGSWRALEELKENGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 8990 - protein, 474 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSQGLRQYNLDNMMDGFYIAPAFMDKLVVHITKNFLTLPNIKVPLILGIWGGKGQGKSFQCELVMAKMGINPIMMSAGELESGNAGEPAKLIRQRYREAADLIKKGKMCCLLINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPDQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAQQVNLPVPEGCTDPVAENFDPTARSDDGTCVYNF

SEQ ID NO: 8991 - protein, 190 aa, Mundulea sericea
  misc_feature (68)..(68): Xaa can be any naturally occurring amino acid
EVVAESKRPDLEPYIGLHYPATDIPQASRFLFKQNRVRMIVDCHASPVRVVQDEALVQPLCLVGSTLXAPHGCHAQYMANMGSIASLVMAVIINGNDEEGVGGRSSMRLWGLVVCHHTSARCIPFPLRYACEFLMQAFGLQLNMELQLAAQALEKRVLRTQTLLCDMLLRDSPTGIVTQSPNIMDLVKCD

SEQ ID NO: 8992 - protein, 200 aa, Dalbergiella nyasae
EDDHGEVIAEITKPGLEPYLGLHYPATDIPQAARFLFMKNKVRMIVDCHAKHVKVLQDEKLPLDLTLCGSTLRAPHSCHLQYMANMDSIASLVMAVVVNDNEEDGDSSDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 8993 - protein, 436 aa, Arabidopsis thaliana
MASWIFKLLLLLQCVLVLIQHADSSSIIRYLPGFEGPLPFELETGYIGVGQKEEDQLFYYFIKSENNPEEDPLLVWLTGGPGCSSFSGLVYENGPLAFKVETYNGSVPTLVSTTYSWTKVANIIYLDQPVGTGFSYSRNPFADIPSDTGSVKRVNEFVRKWLAKHPEYFSNPFYVTGNSYSGKVIPAIVQEISNGNYICCKPQINLQGYVIGNPVAYYDHDKDFRIPFAHGVALISDELFESLKASCGGSYSVVDPLNTECLKLIEDYDKCVSGIYEELILKSKCEHTSPDCYTYRYLLSEYWADNETVRRALKVVKGSKGTWERCDYRVLSNQDIKSSIPFHINNSIRGYRSLVISGDHDMTIPFLGTQAWIRSLNYSITEKWRPWMILDQVAGYTKTYANKMTLATVKGGGHTLEYKPEENSVLFKRWISGQPL

SEQ ID NO: 8994 - protein, 547 aa, Escherichia coli
AAKDVKFGNDAGVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTVAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 8995 - protein, 196 aa, Dalbergiella nyasae
DHGEVVAEVKKPGLEPYLGLHYPATDIPQATRFSFMKNKVRMIVDCHAKHVKVLQDKKIPFDLTLCGSTLRAPHSCHLQYMENMNSSASLVMAVVVNDNDEDGDSSDAIQPQKRKRLWGLVVCHHTTPRFVPFPLRYACEFLAQVFAIHVNKELELEYQIVEKNILRTQTLLCDMLMRDAPLGIVSQSPNIMDLVK

SEQ ID NO: 8996 - protein, 187 aa, Dalbergiella nyasae
EDEHGEVVSEIRRSDLEPYLGLHYPATDIPQASRLLFKQNRVRMICDCDAKPVKVIQSEELRQPLCLVNSTLRSPHGCHTQYMANMGSIASLVMAVIINGNDTTRLWGLLVCHHTSPRYVPFPVCYACEFLMQAFGLQLYMEIQLASQMAEKRILKTQTLLCDMLLRDAPFGIVNQSPNIMDLVKCD

SEQ ID NO: 8997 - protein, 284 aa, Ralstonia solanacearum
MRRSEEESGMVQGGVPLAVEAIAAFTDNYIWALHDGRVAAVVDPGDAQPVLRFLQARGLALGAIVITHHHGDHVGGVQALVEAYPRDPSGAPLPVIGPADESIPCRTQAVREGDTVTLSHPAATFHVLDVPGHTRGHVAYVGRLQGPDAPASLFCGDTLFATGCGRLFEGTPAQMRLSLSKLAALPPDTRVYCAHEYTAANVRFARAVEPGNAALAAWEDEVASLRTDGRATVPTTVGHERATNPFMRSNEPAVAASVAQHAGIGVDDPVAVFAALREWKNGFR

SEQ ID NO: 8998 - protein, 169 aa, Oryza sativa
  misc_feature (146)..(146): Xaa can be any naturally occurring amino acid
FLDIKDAEGGQRVNRVTVFERPGLHEFLQRTSEFADLILFTAGLEGYAKPLVDRIDAHNRFCHRLYRPSTVTTEYREHVKDLSCLSKDFHRIVLVDNNPYSFLLQPLNGIPCLTFSAGQPVDDQLMGVIFPLLKHLSLQNDVRPAXLYETFHMPEWFQRHGIPQIDQAA

SEQ ID NO: 8999 - protein, 215 aa, Yersinia pseudotuberculosis
MKYQIIPVTAFSQNCTLIWCEATGQAALVDPGGEATKIIAEVERQGVTVSQVLLTHGHLDHVGAAAEVAAHFQVPIYGPEKEDTFWLEGLPAQSRMFGLSECEAFTPTRWLEEGDKITVGEIELSVLHCPGHTPGHIVFIDPQGRLALVGDVIFKGGVGRSDFPRGDHQQLINSIRTKLLPLGDDITFIPGHGPMSTLGHERQTNPFIREEPAIW

SEQ ID NO: 9000 - protein, 494 aa, Triticum aestivum
  misc_feature (129)..(129): Xaa can be any naturally occurring amino acid
  misc_feature (138)..(138): Xaa can be any naturally occurring amino acid
MDPYKHRPTSGANAGYWTTNSGAPVWNNNNALTVGQRGPILLEDYHLIEKLAQFDRERIPERVVHARGASAKGFFEVTHDVSQLTCADFLLAPGVQTPVIVRFSTVVHERGSPETLRDPRGFAVKFYTXREGNFDLVXGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNSPKCAHHNNHHDGLMNFMHRDEEVNYFPSRFDPTRHAEQYPIPPRVLSGCREKCIIKKENNFKQAGERYRSFDPARQDRFLQRWVDALTDARVTHEIQGIWVSYWSQCDASLGQKLASRLKMKPNM

SEQ ID NO: 9001 - protein, 306 aa, Prochlorococcus marinus
MVSPLPVSSATNRQQRLWAAVKAHREPLPAKQRRFKWGTTSFMLAMHVAATFALLPRFWSWQGLVAFAVLYWTTVLGVTLGLHRLVAHRSFVVPVWLERILVIMATLACQSGPIEWVALHRHHHRYSDQTNDHHDAGRGLWWAHSEWMLHEIPALDHMDRFAGDLLADPFFRWLDRWFLLLQIPLGLGLYWYGEVAQVHGGGLGLVLWAIPLRLVVVYHVTWFVNSATHAFGYRNFDSPDLSRNCWWVAVLSFGEGWHNNHHAYPSSARHGLRWFEFDITWQHVKALRRLGLARRVQQARYVSGAS

SEQ ID NO: 9002 - protein, 259 aa, Prochlorococcus marinus
MIAIHALSILALLPRFWSWQAITTLLVLYWVTACLGVTIGYHRLLSHRSFRVPHWLERFFATCGTLSCQHGPIDWVGLHRHHHKFSDTDPDHHNSHKGFWWSHMGWMFEPIPAMRVVPRLTVDLAADPYYRWLNKYFLLLQLPLAGLLFWIGSVSGAGGLALVLWGIPLRLTIVYHITWLVNSASHCWGTVAFDSGDNSRNNPWVAALTFGEGWHNNHHAFPHSAIHGLQRGQIDLTWQHIRLMRALGLARKIRLPITS

SEQ ID NO: 9003 - protein, 242 aa, Lycopersicon esculentum
MGRGKVELKRIENKINRQVTFAKRRNGLLKKAYELSILCDAEIALIIFSSRGKLYEFCSNSSMSKTLERYHRYNYGTLEGTQTSSDSQNNYQEYLKLKTRVEMLQQSQRHLLGEDLGQLGTKDLEQLERQLDSSLRQIRSTKTQHILDQLAELQQKEQSLTEMNKSLRIKLEELGVTFQTSWHCGEQSVQYRHEQPSHHEGFFQHVNCNNTLPISYGYDNVQPENAAPSTHDATGVVPGWML

SEQ ID NO: 9004 - protein, 336 aa, Streptomyces coelicolor
MTTSSDVIPDAPQPAGDAAGPSATLGGEQKRSIEQITLLLFITLPFLALVAAVPLAWGWGVSWLDLGLLVFFYFLGCHGITIGFHRHFTHGSFKAKRPLKIALAIAGSMAVEGPLVRWVADHRKHHKFSDDEGDPHSPWRYGETVPALIKGLWWAHIAWMFDEEQTPQEKYAPDLIKDPALRAVSRQFILWTVVSLALPALIGGLVTMSWWGAFTGFFWGSLVRVALLHHVTWSINSICHAVGKRPFKSRDRSGNVWWLAILSCGESWHNLHHADPTSARHGVMRGQLDSSARLIRWFEQLGWAYDVRWPSRSRIDSRRNTDQDGARRRKETAKAA

SEQ ID NO: 9005 - protein, 248 aa, Silene latifolia
MEFSSQITREEGSPSSQRKLGRGKIEIKRIENTTNRQVTFCKRRNGLLKKAYELSVLCDAEVALIVFSSRGRLYEYANHSVKGTIDRYKKASSDNSGASSAAEANAQYYQQEAAKLRNQIRTVTENNRHLMGEGLSSLNMKDLKSLENKLERGISRIRSKKNELLFAEIEFMQKREVELHNNNQYLRAKIAENERAQQSMSLMPGGSSEYELAPPPQSFDSRNYFQVNALQPNNTHYSRPDQTTLQLN

SEQ ID NO: 9006 - protein, 733 aa, Neurospora crassa
MNDISDNSSNSLANGGTVANSDIPKDGTGICAGVLSIDPWLEPFKDTLKSRYSKAQSWIDTINKTEGGLEKFSRGTEIFGFNVDKDNTITYREWAPNAKQASLIGEFNNWDRNAHRMKKNEFGVFEITIPPTANGQPAIPHNSKIKITLELPDGQWVDRLPAWIKYVTQDLSVSPAYEARFWNPPQSERYTFKHKRPSKPESLRIYEAHVGISSPECKVATYKEFTKTMLPRIKNLGYNAIQLMAIMEHAYYASFGYQVNSFFAASSRYGPPEDLKELVDTAHAMGIAVLLDVVHSHASKNVLDGLNEFDGTDHQYFHGGGRGKHDLWDSRLFNYGHHEVMRFLLSNLRFWMDEYAFDGFRFDGVTSMLYLHHGIGTGFSGGYHEYFGPDVDEEAVVYLMLANEMLHQLYPNVITVAEDVSGMPALCLPLSLGGVGFDYRLAMAIPDMWIKILKEKKDEEWDMANITWTLTNRRHGEKTIAYCESHDQALVGDKTLMMHLCDAELYTNMSILTPLTPVIDRGMALHKMIRLLTHSLGGEGYLNFEGNEFGHPEWLDFPREGNQNSFWYARRQLNLTEDGLLRYQYLNNFDRSMNLTEDKYGWLHAPQAYISLKHEGDKVIVFERAGLVFVFNFHPSNSYTDYRIGIEQAGTYRIVLDSDTKEHGGFNRLDPQTRFFTSDLPWNNRKNSTHVYIPARTAFVSPCARVHPFRVGYERPDIPSVVQVRVMRITAAG

SEQ ID NO: 9007 - protein, 445 aa, Mortierella alpina
MATPLPPSFVVPATQTETRRDPLQHEELPPLFPEKITIFNIWRYLDYKHVLGLGLTPLIALYGLLTTEIQTKTLIWSIIYYYATGLGITAGYHRLWAHRAYNAGPAMSFVLALLGAGAVEGSIKWWSRGHRAHHRWTDTEKDPYSAHRGLFFSHIGWMLIKRPGWKIGHADVDDLNKSKLVQWQHKNYLPLVLIMGVVFPTVVAGLGWGDWRGGYFYAAILRLVFVHHATFCVNSLAHWLGDGPFDDRHSPRDHFITAFVTLGEGYHNFHHQFPQDYRNAIRFYQYDPTKWVIALCAFFGLATHLKTFPENEVRKGQLQMIEKRVLEKKTKLQWGTPIADLPILSFEDFQHACKNDNKKWILLEGVVYDVADFMTEHPGGEKYLKMGVGKDMTAAFNGGMYDHSNAARNLLSLMRVAVVEYGGEVEAQKKNPSMPIYGTDHVKAE

SEQ ID NO: 9008 - protein, 445 aa, Mortierella alpina
MATPLPPTFTVPASSTETRRDPLPHDVLPPLFNGEKVNILNIWKYLDWKHVIGLLVTPLVALYGMCTTELHTKTLVWSIVYYFATGLGITAGYHRLWAHRAYNAGPAMSFALALFGAGAVEGSIKWWSRGHRAHHRWTDTEKDPYSAHRGVFYSHLGWLLIKRPGWKIGHADVDDLNKNPLVQWQHKHYLILVILMGLVFPTAVAGLGWGDWRGGYFYAAILRLIFVHHATFCVNSLAHWLGDGPFDDRHTPRDHFITAFLTLGEGYHNFHHQFPQDYRSAIRFYQYDPTKWLIATCAFFGFASHLKTFPENEIKKGKLQMIEKEVLEKKTKLQWGTPIADLPILSFEDFQHACKNDRKQWILLEGVVYDVADFMTEHPGGEKYIKMGVGKDMTSAFNGGMYDHSNAARNLLSLMRVAVVEFGGEVEAQKSRPSVTVYGDHSKEE

SEQ ID NO: 9009 - protein, 223 aa, Sorghum bicolor
IENKISRQVTFAKRRNGLLKKAYELSLMCDAEVALIIFSGRGRLFEFSSSSCMYKTLERYRSSNYSSQEVKVPLDSEINYQDYLKLRTRVEFLQTTQRNILGEVLGPLSMKELEQLENQIETSLKQIRSRENQMLLDQLFDLKSKEQELQDLNKDLRKKLQETSPENALHVSSWEEGGHSGASGNVLDPYQGLLQHPESDPSLQIGYHQQAYMDQLNNEDMAG

SEQ ID NO: 9010 - protein, 701 aa, Cryptococcus neoformans
MSARNLASGTPYRKNLSPANSSHFDAPSVSSTSDSVKSAYSVGYTPVPTADRSYSGLLHGTLSKVFRKGGQEIIVSEEPVSFSSSKEDSESTRFNGCPYMNGSIPQTPTPKSTSKSASVAVPVPLPPPSAARLKVQKQNDSIPRENGNALADDVGKLTVRSYEKDRDLKSQEVIYTTSNGVPVPHPYAVQRAGVNGPLLLQDFHLIDLLSHFDRERIPERVVHAKGSGAHGTWECTDGLEDLCLANMFQKGTTCPLTIRFSTVGGESGSPDLARDPRGFAVKFRTAEGNWDFVANNTPVFFLRDPAKFPHFIHTQKRDPATHLSGGDDSTMFWDYLSQNPESIHQVMILMSDRGIPAGWRHMHGYYGHTLKIVNDNGDWVYAQFHLISDQGNKFFTSEEASTKSPDWGQKDLYEAIGRGEYPSWTMKVQVMTQEQAEEAWEKKRINVFDLTHVWPHGDYPLRTIGKITLNENPSNYFAEVEQATFNPAHMIPGVEPSADPVLQARLFSYPDAHRHRVGANYQQLPVNQSATPYATGNFQRDGAMAFYNQGGRPAYLSSIEPIKFREKRVNLNKVHGQFIGEAVSFLSEIRPEDFNAPRALWQKVFSDESKERFIQTVAGHMSTCKRKEIIARQIAIFRQVSPDLGARLEKATNVRGYGSIEGMSFNGTHNGFGVKRGANGLRQDADVVFNNGAPQKTQRAR

SEQ ID NO: 9011 - protein, 246 aa, Silene latifolia
MGRGRVQLKMIENKINRQVTFSKRRSGIIKKAHEISVLCDAEVALIIFSHRGKLFDFASDSCMEKILERYERYCYAEKQLASNDPDAQVNWTFDYAKLKAKLDLLQRNHRQYLGQDLDALNLKELQSLEQQLDVGLKHIRSKKNQLMHDSISELQKKERSMEEQNKMLTKKIKEKGKAATTETQQMQWQQQQQNHQDVATSSDYLIHPPVPLNMSNSYEKEQGGEGSRNDLNLTLESNCWAHHSLF

SEQ ID NO: 9012 - protein, 257 aa, Silene latifolia
MGRGRVQLKRIENKINRQVTFSKRRTGLLKKAHEISVLCDADVGLIVFSTKGKLFEYATDSCMEKILERYERYSYAERQLTAPDPDSHVSWTLEHAKLKARLEILQKNHRHYMGEDLDTLSLKELQNFEHQLDTALKHIRSKKNQLMYESIHELQKKDKALQEHNNTLSKKVKEKEKEKEKEKAIADQQAQWVQQNQELNPSAFFSSQVLPALNIRGNYETGSSVIVNEVAQTQNRSNSSNNNSLVPSWMLNHLAEQ

SEQ ID NO: 9013 - protein, 1555 aa, Wolinella succinogenes
MKKLFALVTLLLLGLTLHASTQKLSLRLQWKHQFEFAGFYTAIEKGYYQEAGLEVELKEYENGVNIIQEVLEGKSHFGIWGSGIIKEQMEGKPILLLANYFKRSPLAIVTSPEIKSPGDLKGKRLMLSEVNIDSANFTHMLQGFGLSMKDIQILSTSFNIHDFIDGKVDAYSIFLTNELFDLQRLGVRYNILDPSNYGVELYDENLFGAKEFVLKNPTLVKRFIDASNRGWQYALDHPEEIVDLILERYNTQNKTKEQLLFEARETAKMVLSRSYPIGSIDPHKVRKIGEIFAEARLAPPAKDYASFLFGQIRTSLDLTEAERAYILMRPTLRVQNESDFAPMNYHSDGGQPAGFSIDYIKLLASKVGLKVEYVSGPTWSEFLQMMRDGRLDAMVNIAKSPEREEYLLFTSPYSEIISAVFTKDSRAQEFSSLNDLKGKKLAVVKGFFEEALLKKHYPEIEMVFAEDTLSALKMVAFGKADAAINSLQVGNFLIKKSGLSGMAPAFEVQDPQFRVNLHVATSSSNSTLRNLLEKAKEQVSDSELLLLTSKWFLQGNAPDKEKRITLSEKERAYLKARSTPFTLCVDPLWMPFEKLDSKGNYEGIAADLLKIVFERTGVEAKVLQTKDWVETLNAVKSGQCDILSFSNQTPAREEWLLFSDPLFQDPNVFITHADHPFITNPKSLEGKTIVLPKGTSIEEWVRRDYPWLKLILVETEEEVFKALLERKADLSIRSLTVAAYTIKKEGLFSLKIAGQLPEKDNHFRMGIKPKEPILRDILNQGIHTLTPEEIDRIANKFVSVNIQKGFDYSLLWKILIGMAGIFVGFFYWNRKLTEYNKALQAAKEKAEAATQEKSNFLANMSHEIRTPMNAIIGMTYLAQQTDLTPLQRDYLQKIEGSANALLGLINDILDFSKIEAGKLEIECIDFDLHSVIEHVSTLVELKATEKNLEFVVSYDQGMNMNLHGDPLRLGQILTNLANNAIKFTHEGEVGIYITKQELHRYRFEVRDTGIGLSPGQKEKLFRSFSQADTSTTRQYGGTGLGLAISKQLVEMMNGRIWVESEEGKGSSFIFEIELNEQENAPKESKAFSHKHVLIVDDTPSWQKILARLLKGFHIEVSVASSGEEALRLIKEQPGFYDLILMDWKMPQMDGIETTKLIKESCETPPPTIIMVSSYRQENIVNAAKEQGINVFLQKPINPSLLYNVLLEILGEGIKQSGVQKADSHSLKNELTTRAGSQILLVEDNAMNREIIMGMLQPFGIRIDIAQNGQEAVTLYQENPKRYELILMDIQMPVMDGYEATKILRAQGANLPIIALTANAMKSDIERTKAAGMDEHLNKPIVVEKLFGTLLAHLTPKCAPQENPSLAPQELQSSTLPTLVHTDTLKGIAHLAGDEALYRKLLRDFIEHYENLEIEPASQEGARILHTLKGLSANLGMDELSRLAKECEENPSLTSLASLTQALSQALQELKESGILSDSTPLIPQIAAPEGRVEEIWSELGSLLPKRRPPLCKPLLEELEGYALNERDRALFERLKPLVERYKFSEALKILEERLS

SEQ ID NO: 9014 - protein, 310 aa, Orobanche ramosa
MVITLNNGFKMPIIGLGVWRTEGKDLKNLIINAIKIGYRHFDCAADYKNEAEVGEALEEALQTGLVKREDLFITTKLWNSDHGHVVEACTDSLKKLRLEYLDLYLVHFPVATKHTGVGTTDSALGDDGILDIDTTISLETTWHAMEDLVSLGLARSIGISNYDIFLTRDCLAYSKIKPAVNQIETHPYFQRESLVKFCQKHGICVTAHTPLGGALANTEWFGTVSCLDDPVIKGLTEKYKKKTVAQIALRWGIQRNTVVIPKTSKQDRLIENFQVFDFELSNEDMELLKTMERKYRTNQPAKFWGIDLFA

SEQ ID NO: 9015 - protein, 408 aa, Chlamydomonas reinhardtii
MQVTMKSSAVSGQRVGGARVATRSVRRAQLQVVAPSRKQMGRWRSIDAGVDASDDQQDITRGREMVDDLFQGGFGAGGTHNAVLSSQEYLSQSRASFNNIEDGFYISPAFLDKMTIHIAKNFMDLPKIKVPLILGIWGGKGQGKTFQCALAYKKLGIAPIVMSAGELESGNAGEPAKLIRTRYREASDIIKKGRMCSLFINDLDAGAGRMGDTTQYTVNNQMVNATLMNIADNPTNVQLPGVYKNEEIPRVPIVCTGNDFSTLYAPLIRDGRMEKYYWNPTREDRIGVCMGIFQEDNVQRREVENLVDTFPGQSIDFFGALRARVYDDMVRQWITDTGVDKIGQQLVNARQKVAMPKVSMDLNVLIKYGKSLVDEQENVKRVQLADAYLSGAELAGHGGSSLPEAYSR

SEQ ID NO: 9016 - protein, 846 aa, Arabidopsis thaliana
MASSSLSNLMLAIHEKKTSSVDLYRPLRNYVTFTYSEREAQLIDDDLETLKQLRSDIERVSDPSPAARRDLLISYYKVLCLVETRFPISPDKDHVNAVSFVWYDAFKQKHKATQQNIHLEKAAVLFNLGASYSQIGLGHDRTTVDGRRQASHAFMAAAGAFAHLRDNESIKATIGPSTTVDVSVECVGMLERLMVAQAQECVFENTIAKGSTPGVSAKIARQVGIFYEEALSALIISPLKDHFDKGWISHVQLKAALFYGEACFRYGKELHEKEEIAEEIARLRSGASRLAEAKKSSRGAPAQLIEAMNTLESSINGNLDRAVKENDRVYLMRVPSPSSLSPLPAFSMVKPMNMTDILDASKEKMFSILVPDSSAKALSRYTEMVDDVIRTQAERLQQASELTRVRLKEMDLPDSILAVDGNSALPVDLKEDVEAVQISGGPAGLEAELQQLRDLKRVNQELLVHTEELLQKEATEDSQFRSQFGTRWTRPQSSTLTKNLQDRLNRFAANLKQAGESDVKIERSVRDNSALMSILDRRPIESAVPTLARPIMSLDATEDAIVGTLKQSLRQLENLGAQRAGLEDMLKEMKRKDDILPKLMTITGSYEDMFRKEISKYDHICEDISQNIEVQEQLLMQIQAQNEEFSTIFNLEDYKASKEKCYKQIQAAIMKYREIKENINEGLKFYVTLQDAITNVKQQCSDFVMTRSIQCRDMIEDVQRQMSGLSFQDHRSSGPYPSVHQPTASSPPPPPETQNPSHPHPHAPYYRPPEQMSRPGYSIPPYGPPPPYHTPHGQAPQPYPPQAQQQPHPSWQQGSYYDPQGQQPRPPYPGQSPYQPPHQGGGYYRQ

SEQ ID NO: 9017 - protein, 457 aa, Bifidobacterium longum
MSNDDLTHENFDFRGFDVPDLKAVTLASSSDGDQSKQPKTKHEDASKNRKHGKKKSKSDARSKKRAGAGKTSESFDDYEDYEEREAVSKADKKVSKDRPGLFAPMTLREVTVRNRIWLPPMCTYSSFARDGRPTPFHYQHYVSRAFGGFGMVIVESTAVAPEGRITPCDLGLWEDGQIDAWRWIVDGIREAGAVPAIQLNHAGRKASTGCFAVGYDGQSVPEEAGGWPTMAPSEIAFGGLRTPRALSVDEIHGLVGAFAAAAGRAVAAGFQAIQIHAAHGYLISQFLDPLSNERDDEYGGDLTGRSRFLVEVVDAVRGAVPEGVPVLVRISATDWAAGGWDLDQTIALSKVLKEHGVDVMDVSTGGIMSGVSIPVKPNYQVPFSEQVKAKADIPVTAVGLITKPKQAAKILAHGEADAVEIGRAALRDPYWPLRAANKLGIPSTEIPYAPQYVAGAY

SEQ ID NO: 9018 - protein, 361 aa, Aspergillus nidulans
MATDTSTYKLNHTMLRVKDPKRSVEFYKFLGLNQVQQLDFPDNKFSLYFLAYNGPQSLQGDRHWTDRNAVLELTHNYGTENDPNYSITNGNTEPHRGYGHIAISVDNIEAACQRLEDAGYAFQKKLTEGRMRHIAFVKDPDGYWVEIIKRRDEAMSTSTDPATYRLNHTMLRVKDAEASLKYYQEVLGMTLVRTIENKEAAFNLYFLGYPASNPQATEGANNPVAEWEGLLELTWNYGTEKQEGKVYHNGNDEPQGFGHICVSVDDLNAACERFESLKVNWKKRLTDGRMKNVAFLLDPDGYWIEVIQNEALKRTSNWRIVQARCRPIWVKDSAVSNGGTITHEYKLIKGFARGLEFGGGI

SEQ ID NO: 9019 - protein, 154 aa, Zea mays
MSLVRRSSVFDPFSMDLFDPFDSMFRSIVPSSSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 9020 - protein, 750 aa, Ralstonia eutropha
MNRVDTRPPERRTQTISDGELGALVEGRHRDPFAILGPHRDGDTLIVRACVPGAHSVMLADSRGEPLAPMTPLHAGGVFTGRLPAGVSVYQLLVRWHNGTQQVSHDPYAFGLLLGELDLHLIAEGRHFELGACLGAQWRNVDGVQGVRFAVWAPNARRVSVIGDFNGWQPARHPMRLRHPSGVWELFIPEAMGARPGCRYKFDLLDPHDAQLPDKADPLALATEAPPATASVVTQPQVSAPPFAWQDDEWMRLRNAVDPYAAPLSIYEVHVGSWLRAANDPARGWEVLADRLIPYVHELGFTHIELLPVTEHPFGGSWGYQPLSLYAPTARLGPPQAFAAFIDRCHRDGIGVILDWVPAHFPTDPHGLARFDGTALYEHEDPREGFHQDWNTLIYNLGRNEVRGFLLAGALHWLEHFHVDGLRVDAVASMLYRDYSRAPDQWVPNRFGGRENLEAVAFLRELNTVVHERCPGALTIAEESTAWPGVTASAASGGLGFDFKWNMGWMHDTLRYLSLDPIHRAWHHQDMTFGTVYAWSEAFVLPLSHDEVVHGKGSMLRKCPGDDWQRFAGLRAYYGFMWAHPGKKLLFMGGELAQWQEWNHDAELDWALLDHPMHRGVHTLVRDLNALYRELPALHELDHSPAGFQWVVGDDHQNSVFAWLRRPAPGSGDVVLAVTNMTPVPRYGYRIGVPSEGCWHERLNTDAACYGGSNLGNGGAVTAEPVPSHGQEASVLLTLPPLATVILQHAGTQA

SEQ ID NO: 9021 - protein, 167 aa, Glycine max
  misc_feature (101)..(101): Xaa can be any naturally occurring amino acid
  misc_feature (119)..(119): Xaa can be any naturally occurring amino acid
MAAISSTSYFSSQPQLPASDGANPATARSSSSNGREPRRRRTGRCIMLEADAASASGSGGAAAGRTRSLTEEDLEELKGCLDLGFGFSYHQIPGLCGTLPXLELCYSMTRRFLDEQRTXSGSLEPATAAAAPITDWKISGPGDDPDEVKARLKYWAQTVACTVKLCT

SEQ ID NO: 9022 - protein, 500 aa, Arabidopsis thaliana
MVLSKTASKSDDSIHSTFASRYVRNSISRFEIPKNSIPKEAAYQIINDELKFDGNPRLNLASFVTTWMEPECDKLMMESINKNNVEMDQYPVTTDLQNRCVNMIARLFNAPLGDGEAAIGVGTVGSSEAVMLAGLAFKRQWQNKRKALGLPYDRPNIVTGANIQVCLEKFARYFEVELKEVKLREGYYVMDPDKAVEMVDENTICVVAILGSTLTGEFEDVKLLNDLLVEKNKKTGWDTPIHVDAASGGFIAPFLYPDLEWDFRLPLVKSINVSGHKYGLVYAGIGWVVWRTKTDLPDELIFHINYLGADQPTFTLNFSKGSSQVIAQYYQLIRLGFEGYRNVMDNCRENMMVLRQGLEKTGRFNIVSKENGVPLVAFSLKDSSRHNEFEVAEMLRRFGWIVPAYTMPADAQHVTVLRVVIREDFSRTLAERLVADFEKVLHELDTLPARVHAKMASGKVNGVKKTPEETQREVTAYWKKFVDTKTDKNGVPLVASITNQ

SEQ ID NO: 9023 - protein, 359 aa, Unknown
  uncultured bacterium 562
MLFEPYKLKNTILRNRVAMAPMTRNQSPGGIPTNEVVEYYKRRAKAEVGLIITEGVEVSHEASSAYPNVPRLDSEEAREGWKKVVEGIKENNGHVIAQLWHCGGFRKLGMGPNPEIPGHTASGLVRPGKRVAHAMSSFDIEETVEAYASDAKICEELGFDGVEIHGAHGYLIDNFFWTGTNDRDDNFGGSIKSRSFLATSITKAIRDNVSNDFIVGLRFSQWKQQDYAAKLAQSPDDLLEVLSGPCNAGLDYLHSSMRRFWESEFEGSDENLAYWTKKLMNIPTMSVGSVGLDGDFTDMMASAKTASIDKAVQDINDEKYDMVAVGRALLSDHEWVIKMKEGRLEDINPYTKDSLIEMY

SEQ ID NO: 9024 - protein, 731 aa, Mycobacterium avium
MSHADQLARTHLAPDPADLSRLVAGTHHDPHGILGAHEYGDHTVIRAFRPHATEVAALVGGDRFAMQHIESGLFAVALPFTNLIDYRLQITYPDSEPYVVADAYRFLPTLGEVDLHLFGEGRHERLWEVLGAHPRSFTTADGVVTGVSFAVWAPNAKGISLIGEFNGWTGTEAPMRVLGSSGVWELFWPDFPIGGLYKFKVHGADGVVTERADPMAFATEVPPHTASRVTLSSYTWGDADWMTQRAARNPVFEPMSTYEVHLGSWRPGLSYRQLARELTDYVVEHGFTHVELLPVAEHPFAGSWGYQVTSYYAPTSRFGTPDEFRALVDALHQAGIGVIVDWVPAHFPKDAWALGRFDGTPLYEHSDPKRGEQLDWGTYVFDFGRREVRNFLVANALYWLQEFHIDGLRVDAVASMLYLDYSRPEGGWTPNIYGGRENLEAVQFLQEMNATAHKSAPGIVTIAEESTSWPGVTRPTNLGGLGFSMKWNMGWMHDTLDYISRDPIYRSYHHHEMTFSMLYAFSENYVLPLSHDEVVHGKGTLWGRMPGNNHVKAAGLRSLLAYQWAHPGKQLLFMGQEFGQRAEWSEERGLDWWQLDEQGFSNGILRLVRDINDIYRSHPALWSQDTVPDGYSWIDANDSANNVLSFLRYGKDGSVMACVFNFAGAEHSGYRLGLPSAGRWREVLNTDATVYNGSGIGNMGGVDATEDPWHGRPASAVLVLPPTSALWLEPK

SEQ ID NO: 9025 - protein, 159 aa, Triticum aestivum
  misc_feature (116)..(116): Xaa can be any naturally occurring amino acid
MSLIPRGNAFDPFSPDLWDPFDGFPFGSGGSSSLFPSFPRISSETAAFAGARIDWKETPEAHVFKADVPGLKKEEVKVEVEDGNVLQISGERNKEQEEKTDTWHRVERSSGKFLRXRFRLPEDAKADQIKATMDNGVLTVTVPKEGAKKPEVKSIQISG

SEQ ID NO: 9026 - protein, 741 aa, Vitis vinifera
MESCDCIDPPWPGDELLMKYQYISDFFIALAYFSIPLELIYFVKKSAVFPYRWVLVQFGAFIVLCGATHLINLWTFGMHSRNVEVVMTTAKVLTAVVSCVTALMLVHIIPDLLSVKTRELFLKNKAAELDREMGLIRTQEETGRHVRMLTHEIRSTLDRHTILKTTLIELGRTLSLEECALWMPTRTGLELQLSYTLRQQNPVGFTIPIQHPVINQVFSSNRAVKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAVRARNDFLAVMNHEMRTPMHAIIALSSLLQETELTPEQRLMVEAILKSSSLLATLINDVLDLSRLEDGSLQLENGTFNLHALFREVLYLIKPIASVKKLFVSSSLAPDLPEFAVGDEKRLMQIMLNVVGNAVKFSNEGNISIFAFIAKSESLRDSRAPDFFPVHSDNHFYLRVQVKDSGAGIDPQDISKLFTKFAQCQSLAARNSGGSGLGLAICKRFVNLMGGHIWIESEGLGKGSTAVFIVKLGIPEYSNESKLPFFPKVSANHCQTNFPGLKVLVMDDNGVSRSVTKGLLVHLGCDVTTVSSADDCLRVVSQEHNVVFLDVCMPGVDGYEVAIRIHEKFTTCRQGPLLVALMGNTDRVTKENYLRVGINGVVLKPVSVDKMRCVLSEVLEHRFLFETC

SEQ ID NO: 9027 - protein, 401 aa, Guillardia theta
MQEDMEYNIRFVGSYILDKTLGVGATGKVKLAKHSRTKEKVGVKIIKKDLFYDKPSLRLKIQREISVMKLMFHPHVIKIYDVLEDSKYLFLIIEYASKGELFNYLVEKRKLENREALKFFHEIISGLEYCHKHRICHRDLKLENILLDMKLQIKIADFGMASLSIPNIMLKTFCGSPHYASPEVVSNEPYNGIKADIWSCGIILYALVVGKLPYDEENDNMRKLFNKIRFEPPRIPRIIHPDCRDLIRALLTINPQKRITIDKIKKHPWYKSSPLPESCRISIQNLSFASVQNPISNPDPEIISFLLPLQLVKDKKTLCGILSTKKPSFLRVLYRQLEWRKMKMDSVRSNLINEANFKRKKLFKQGKLGNITGLKYWKNLKCKFLSINIKSFVRTGIYIYF

SEQ ID NO: 9028 - protein, 479 aa, Streptomyces coelicolor
MVTAAHRTASAPDAARTFPKGFLWGSATASYQVEGAAAEDGRTPSIWDTYARTPGRVRNGDTGDVATDHYHRRSEDVALMAELGLGAYRFSLAWPRIQPTGRGPAVQKGLDFYRRLVDELLEKGIQPVATLYHWDLPQELEDAGGWPERATAERFAEYAALAADALGDRVRTWTTLNEPWCSAFLGYGSGVHAPGRTDPVAALRAAHHLNLAHGLAVQALRERVRADAQVSVTLNIHHVRPLTGSEGDADAARRIDALANRVFTGPMLNGAYPEDLLKDTAELTDWSFVQDGDLRQAHQPLDFLGVNYYTPTVVSETDGSGAHTSDGHGNSSHSPWPGADRVAFHQPPGDTTAMGWAVDPTGLYDLLRRLSADFPRLPLVITENGAAFDDYADPEGQVNDPARIAYVRGHLAAVHQAILDGADVRGYFLWSLLDNFEWAHGYSKRFGAVYVDYPTGTRIPKASARWYSEVARTGVLPGA

SEQ ID NO: 9029 - protein, 190 aa, Glycine max
KIKKREMATETKVAVLGGITEVQGAANSVEINNLARFAVEEQNKRENSVLEFVRVISAQQQVVSGVNYYITLEAKDGEIKNEYKAKVWERESQELLEFMPTLGAGGEIDHLARFAVEEQNKRENANLEFVGVIRAKQQVVEGFIYYITLEAKDGETKNVYETKVWVRSWLNSKEVLEFKPISINPLSVSV

SEQ ID NO: 9030 - protein, 743 aa, Ralstonia eutropha
MNIALQVPDRLLPGKPYPLGAQWDGLGVNFAVFSANASRIDLCLFSANGRKELARMPLPECTDEIWHGYLPNAALGTLYGFRAFGPYDPARGHRFNPHKLLLDPYARRLSGPVRWSDALFGYRLQSARADLTPDRRDSAPTMPKAVVVDESFHWGDDRPPGVPWQDTVIYEAHLRGVSMLRDDVLPHQRGTFAALCDPRFLDHLLRMGITAVELLPIHAILQDRFLLERGLRNYWGYNTLSYFAPEPSYLATDQLHELKVAVRRLHAAGIEVILDVVYNHTCEGNELGPTVSWRGLDNASYYQLVPGDERHYLNDTGCGNMLNLPHPRVLQMVLDSLRYWVQCFHVDGFRFDLGATLGRDHNGFDPGASFFDAILQDPVLSRVKLISEPWDLGPGGYQLGNHPPGFAEWNDKFRDTVRRFWRGDSGQRGELAARLSGSADLFDRRHRRPWASVNFITAHDGFTLADLVSYNGKHNDDNGEENRDGTDNNYSANWSPDGSVEGPTDDPAILALRARVAQAMLSTLLLAQGTPMLTAGDEWGRSQQGNNNAYCQDNAMSWLDWKQAQTPRGQVLLQMVRRLLALRLRLPSLGANHFSHGNQEPAPGIGDIAWFDTEGQPPSPEAWAAPEIRTLALRRAAAPPRSERLELAHRATREGQPGPVNVTLLLLNAGDTDVVFRLPEPALAWQLVLDSSQPQAEAGRPSNAITEQAVPAHSLVLLAAQAAPQRFDHPAEPARAAPQEAAS

SEQ ID NO: 9031 - protein, 546 aa, Bacillus thuringiensis
MEENQDMNSLDEQDVKRETLTTRQGHPVKDNQNIRTIGNRGPATLENYHFIEKISHFDREEVPERVVHARGAGAFGYFETYGKVGDEPVEKYTRAKVFSGAGKKTPLMVRFSTVAGAKDSPETARDPRGFAVKMYTEDGNWDLVGNNLKIFFIRDAMKFPDMIHAFKVDPVSNVANPERMFDFVSRTPEATHMITFLFSPWGIPATYRHMQGSGVNTYKWVNEKSEAVLVKYHWEPKQGIRNLTQEDANSIQAMNVSHATQDLYEAIQRKDYPEWELFVQIMEDGYHPELDFDPLDDTKLWPEEQFPWLPVGRMVLDRNPVDYHSEIEQAAFGTGVLVDGMDFSDDKMLQGRTFSYSDTQRYRVGANYLQLPVNAPKAPVRTNQHRGQMDMRNPKESGENPHINYEPSMLGGYKDAKQEKHHPHQPTYNAAAMSAPIDRPNNYGQAGHTYRSFEEWERNELVKNLSEALAVCDKRIQNAMIEHFTQADEDYGRRVKEGIEKKMKEAKTENKLPGREVSKSKYGQGSLAANEATKDAVKKSHESDPY

SEQ ID NO: 9032 - protein, 191 aa, Cryptococcus neoformans
MSEHTNLKSLAPLGNQPEPSANSAGVGPSKPFTEAQVEEFREQDRWLPIANVARIMKSSLPTSAKVSKEAKECVQECVSEFISFITSEAAEKCLNEKRKTLNGEDILTSMRALGFDNYEGVLRVYLAKYRDSHHSIPKRNAQHEDDDEEVQDGRKKRGRGRQPAGGTISTNGHAEGTKSKRKRSDDGKGVR

SEQ ID NO: 9033 - protein, 687 aa, Ralstonia eutropha
MEFATSHRLAAVFSHWNRSFQAQELILNLTSFFLGTGATSATPRLAPLDSFSASAPQVPAANDDPHSYAFGPVWLPEGRIGFRLWAPDAAQRGESVRLEIAGMGPVRMTACENGWYRAAVPCADGTRYWFRLDDGTTFPDPASRWQPNDVHGPSVACQPKARTYPWKCPDWRGRPWHEAVICELHVGLCGGYAGAMAQLQRLSALGFTAVELMPLAEFPGARNWGYDGVLPFAPESGYGKPDDLRALVDEAHSLGMMVLLDVVYNHFGPEGNYLHHYASAFFRQDRQTPWGPALDFRRREVRRFFTENARYWLEEFRFDGLRLDAVHAIDDEGWLTTLPSDLRALHGLQGRHVHLVLENDHNDASLLSAGFDAQWNDDAHHALHVLLTGEQDGYYRDYGATPGRPANTSQNAGQNTPLRHLARVLREGFAYQGEVSPYRSECDPAQGPVRRGKPSGHLPPTAFVSFLQNHDQIGNRAFGDRLATLADPDALRVAVALQLLCPQVPLVFMGEECGAQTPFYYFTSHPPELAEAVRQGRRQEFAGMAAFRDESQALEIPDPNDPATFEASRPPMDVENDWTRYYRRLLAIRREWLMHRLPRARISGVDVLGPAALRARWRLGDGTCLSIWVNLGEHVAACQPPAPGYAVLHETASGHADAVAGGSLPAMSCIAILSGHGEQAHGAGGAR

SEQ ID NO: 9034 - protein, 860 aa, Rhodopirellula baltica
MWQAWYEYRIDYALFTIVFLVGHSSILSRVRRAMPPPSTTHPETSTSPEAIGSGLRTRLSFCILVLLLIGGFIAVETADRVQRSRMRQQVFGIAPTYAAELQQLGHANIDEQTSPDDPQYLRMIEAQKRWLSVNPQVTDIYTMRRVTELDLSTRPLPDRENNNGHLYKIIVDSETDYSGDGRIEGVRESRTEIGEIFSDSSVEQIEQAFRGVTTFANQPSRDRWGKWVSAYAPLFDADGKVEALVGVDFPAENYIHSIILTRLGAMGIIAALITLFLGAVTSIGMLKAGIVAQQRSHALLQDQRDLATQAAAQARQAAIIKNQFLANMSHEIRTPMHGILGTAELMTRSSLDEQQRHYMYMIQTSAKGLLTVLNDILDFSKVDSGQMTLESVPFELKDLLSQTMHAVVNLKNEEVDLQFQPPVGVPEIIVGDPTRLRQVLINLVGNALKFTEQGRVTVTVENETRDATTLDTSDSKGSRIAFTITDTGIGMTQQQQAKIFEAFTQGDSSTTRRFGGTGLGLSISSQLVELMGGRLQVSSVPNEGSSFRFDIPLRTTNGVEPHEIAKTQPLETSTKSFGQCDQPRELLLVEDGAINRTVAETMLRSRGHRVTSVSNAKDAIEQLRLHSFDLVLMDVQMPEIDGLTATQIIRNDLPAPASEVPIVALTAHAMREDRQRCLDAGMNDCLTKPYPPEVLFETIESFATHTDNQDDLVSSPQSIEKSPSTNVDEPSAEPLNREVILHNVGGDLQVLAMLVQTITDELPPQMQRLQQAIEVGDSTQIARAAHTLKGTASAIGATRAQEIADRLETFSSGETSQEKSSHFFNNQMKALASAFDLAQTELKKFLRSSSGRENPGNETL

SEQ ID NO: 9035 - protein, 392 aa, Xanthomonas axonopodis
MHGNHSPETLRDPHGFATKFYTSEGNWDLVGNNFPTFFIRDAIKFPDMVHAFKPDPRTNLDDDSRRFDFFSHVPEATRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPEDLAKFDFDPLDATKIWPDVPEQKVGQMVLNKNVDNFFQETEQVALAPANLVPGIEPSEDRLLQGRIFSYADTQLYRIGANGLSLPVNRPRVAVNNGNQDGQGNIGQTTSGVNYEPSRLEPRPQDTAARYSELPLSGTTQQAKITREQNFKQAGELYRSYSKKDRADLVQSFGESLAATDTESKHLMLSFLYKADPEYGTGVTRVAKGDLARVKQLASSLQD

SEQ ID NO: 9036 - protein, 172 aa, Xanthomonas axonopodis
MRPGHLMVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPFFVGGAWQPLAGDAARSAWLRHQVLHQRRQLGSGRQQLPHVLHSRCDQVPRHGACVQAGSAHQSG

SEQ ID NO: 9037 - protein, 548 aa, Buchnera aphidicola
MAAKDVKFGNEARIKMLRGVNVLADAVKVTLGPKGRNVVLDKSFGAPSITKDGVSVAREIELEDKFENMGAQMVKEVASKANDAAGDGTTTATLLAQSIVNEGLKAVAAGMNPMDLKRGIDKAVISAVEELKHLSVPCSDSKAITQVGTISANADEKVGSLIAEAMEKVGNDGVITVEEGTGLQDELEVVKGMQFDRGYLSPYFINKPETGIVELENPYILMADKKISNVREMLPILESVAKSGKPLLIISEDLEGEALATLVVNSMRGIVKVAAVKAPGFGDRRKAMLQDISILTGGSVISEELAMELEKSTLEDLGQAKRVVISKDTTTIIGGVGEKHSIQSRISQIRQEIQEATSDYDKEKLNERLAKLSGGVAVLKVGAATEVEMKEKKARVEDALHATRAAVEEGVVAGGGVALVRVAGKIADLRGQNEDQNVGIRVALRAMEAPLRQIVSNSGEEPSVVTNNVKDGKGNYGYNAATDEYGDMIDFGILDPTKVTRSALQYAASVAGLMITTECMVTDLPKEDKSSDSSSSPAGGMGGMGGMM

SEQ ID NO: 9038 - protein, 293 aa, Nostoc punctiforme
MTANFGAFAKSVGEAIAPERGKSPQLSWTNVVFFTTFHALALMSPWFFSWSALGLLVFLHWLFGSIGICLGYHRLLSHKSFQVPKWLEYAIALIGALALQGGPIFWVGGHRQHHAHTEDINLDPYSAQRGFWWSHILWIFYPRPEFFDYDTYKKYAPDLARQPFYCWLDRYFLLLQIPFALLLYGLGGWPFVFYGVFLRCVLLWHSTWFVNSASHLWGYRTFDANDGARNLWWVSLVTYGEGWHNNHHTYPHMAKSGLSWWEIDVTWWSILVLQTLGLAKKVVSRPPQGATHG

SEQ ID NO: 9039 - protein, 256 aa, Silene latifolia
MGRGRVELKRIENKINRQVTFAKRRNGLLKKAYELSVLCDAEVALIIFSNRGKLYEFCSGPSSMLKTLERYQKCSYGAVEVNKPSKELESSYKEYLKLKARYESLQRAHRNLLGEDLGPLNVKELDQLERQLESSLKQIRCIKTQSMLDQLTDLQSKEHALMEANKSLKAELERIMVKDNQVRQSWEGHHEHQNVHYEHQHAHSQHQHAHSQGLFQPIDCNPNLHLGYNAETSDHQLTAGTSHAQVPGFLPGWMQM

SEQ ID NO: 9040 - protein, 244 aa, Silene latifolia
MGRGRVELKRIENKINRQVTFAKRRNGLLKKAYELSVLCDAEVALIIFSNRGKLYEFCSSPSMLKTLERYQKSNYGPPDNTAVSSREALEISSHQEYIRLKARYEALQRTHRNLMGEDLGPLSSKELESLERQLDMSLKHIRSTRTQYMLDQLADLQRKEHVLNEANITLKQRLIEADQVSSAQCYGHELDYGRQNPQAQADHVFFHPLECEPTLQIGYQPEQMNVTAAGPSINNFMTGWLPQN

SEQ ID NO: 9041 - protein, 703 aa, Saccharophagus degradans
MIKNIAVSLVFIFSVTCAVAKPPEAPKLIPTKVQSQTIVDVIAQLNARHYRNQAIDDSLSTRFLESYIDSLDPAHMFFYTKDVENFKKHNLKYDDYFRKGKLEEGFEVYRTYRARVVSRLESAIEMLADENVKFDFNAKDEIILDRSELPWPTTQAEADELWYKRTKLSLLNLKLAGKTLEEAKETVTKRYKNQLNRILQQDSADVFEIMVNSLTLLFDPHTNYWSPRTSENFNINMSLSLEGIGAVLQSEDEFTKVVSLVPGGPASKQGQLKPADRIVGVGQGDEGEVVDVTGWRLDEVVDRIRGPKNTVVRLEVLPAKESNGETAVIRIKRDEVKLEDQAAKKGVLELSDEERLYKIGVINLPAFYINFDKANSRDPDYRSSTRDVSRLLDELQAEGVDGIILDLRNNGGGSLREATMLTDLFIDHGTVVQIRTPDGYIARHNHARLRAKYRGPLIVLVNRLSASASEIFAGAIQDYDRGLIVGTQTFGKGTVQSVAPTVEGKIKLTESKFYRVSGDSTQHRGIIPDIELPMLVDMKEVGESAYDNALPWDTIHPVPHAKYFDLDASIPYLTEAHKKRIAHDPDFNYLLDQIAVMEENKRKKAVSLNEKQRIAEKENLEKQAMVIENKRRTGKGQDPYKTLAEYRAAQEEENPEDAPVVSSRETVIDLDGDTLLNESGNILIDYIRFQTTNAQKQASNFSK

SEQ ID NO: 9042 - protein, 478 aa, Prochlorococcus marinus
MNKPRILFWHRKDLRIFDNQALIKAFSLSDAITSTYIFDKNYSHDFNASSRAWFLGNSLQELGNNWKKMGSRLVLEEGDPVLIIPQLAKKIDAKFVFWNRSIEPYEINRDLEIKNNLKEQNIQVIETWDHLLIEPLKIFSGNNNPYSVYGPFYKNLKSKINLLGSFEQDKVVFQFKDIDNKFKENKAINSSDSVLEKFIKNIKFPGSNICPCRPGENAAQTLLENFINEKKIYSYNSARDFPSHNGTSFLSASLRFGTISIRKVWNATLNLNSDFANQENYLSIETWQKELVWREFYQHCLFHFPELEKGPYRKKWDHFPWQNNNELFQHWSNGETGVPIVDAAMRQLNSTGWMHNRCRMIVASFLVKDLICSWQMGEKKFMETLVDGDLAANNGGWQWSASSGMDPKPLRIFNPYTQAKKFDPICEYIKYWIPELSRVSNSELLNGEISNLEKNNYSSPIVNHNIQQRLFKSLYAEI

SEQ ID NO: 9043 - protein, 554 aa, Escherichia coli
MCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 9044 - protein, 286 aa, Pediococcus pentosaceus
MEYVKLNDGNQMPQLGFGVFQVSDLSQAEQAVSDALDTGYRLIDTAAAYDNEEAVGAAIKKSGINRSEIFVTSKLWVDHFTYEKAQQGIEDSLNKLGLDYIDLYLLHQPYGDTAGAWRALIEAQKAGKIKSIGVSNFAPDQLMNLELMSDVKPALNQIEVSPWYQEGEAVGFAQSQDVQVEAWAPFAEGKHNIFSNETIAEIGQKYGKANGQVILRWLLQRGIVVIPKSVHKTRMAENLDVFDFELSDDDMQKMSSLDKNESQFFDHRDPEAIVSIFGESLKALRK

SEQ ID NO: 9045 - protein, 191 aa, Triticum aestivum
  misc_feature (84)..(84): Xaa can be any naturally occurring amino acid
  misc_feature (167)..(167): Xaa can be any naturally occurring amino acid
MMKMTHDDYVHLCLMALASVATGGGQAEAAKGQWLQTLPATTAAACELRFRCSVCGKAFPSHQALGGHKASHRKRAALVLPLKXVSPAEETVASSTSSGVGGHRCSVCHRSFATGQALGGHKRCHYWDGLSVSLTASASGSGSSARDFDLNLTPVTEKAAAGMRRWXEEERGAEPLAVQERRLSSPSLELN

SEQ ID NO: 9046 - protein, 405 aa, Escherichia coli
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPCGALYMFPKIDAKRFNIHDDQKMVLDFLLQEKVLLVQGTAFNWPWPDHFRIVTLPRVDDIELSLSKFARFLSGYHQL

SEQ ID NO: 9047 - protein, 284 aa, Synechococcus sp.
MSYPLHLFWHRRDLRLADNLGLYAARQHTPTVVGVFCFDPALLQGQDVAAVRVAYLLGCLQALKEAYQQRGGCLLMVQGDPRQVIPEVATTLKATAVHWHEDVEPYARERDRVVAATLNDLGIAVHRQWDQLLHPPSAVQTQQGQPYTVYTPFWRNWSALPKAAPVPPPPDFAPLEATEIASIPLPSTHDLGFDWSGELILAPGEAAAAQQLAHFSQHAIYEYGEQRNYPGRPGTALLSPALKFGVIGIRTVWAASEAALEHARSDEARASIRTWQQELAWREF

SEQ ID NO: 9048 - protein, 454 aa, Novosphingobium aromaticivorans
MSDPVIVWFRRDLRLADQAALLAAAAEGPVIPVYILDDDTPRHCRMGGASRWWLHHSLAELDASLRKLGSRLILRRGKCHEELAAVRREAGARVVHALQHYEPWWRNAEKAVAKTIRLVLHEGNYLAPAGSVRTGMGRPYKIYTPFWHALLERMPPAPPLPAPERLEAPAVWPTSDALDDWKLLPTAPDWAGGFRETWTPGENGAEERLQDFADRVARYGETRNLPSIEGTSRLSPHLHFGEISPATIWHRVVNAGGSVDVFLGELGWRDYAQNVIVQFPDYGSRNAREAYDRLEWRDDPEALRAWQQGRTGYPIVDAGMRELWHTGWMHNRVRMIAASFLVKHLLIDWREGERWFWDTLVDADYASNAVNWQWTAGTGVDSNMFVRIMAPLTQSPKFDAAGYIRQWVPELAHLSDRDIHDPAVPPRGYPAKIVSHSEARARALAAHDRMKQPA

SEQ ID NO: 9049 - protein, 533 aa, Solibacter usitatus
MARRRRSLFVLPVIVFACSIAGGFYGPKVEVAAAASQSEDLDKDVRDFSKVLSLVQDNFADHVSADKTIYKGAIPGMLRTLDPHSNFFDAREYQLMREDQKGHYYGVGMQVSPQPSGKTAVKAPFPGSPAYKVGLRPGDLLISVNDKSTEGLNTTEIADLLKGPRGTSVKIVVSREGTKDYLTFTVVRDEISRKSVQDAFWIKPGYAYVKILSFGENTSRELEENLKRLGENNIKGLVLDLRENPGGLLNEGVAVADHFLPKNALIVSHRGRSAPEKAYVAQHGNRGRDYAMVVLVNRYSASAAEIVSGALQDHDRALILGETTFGKGLVQTVYPLSDNTALALTWAHFYTPSGRLIQRDYSNKSFYDYYTHRDESTRNPVDVKMTDGGRTVYGGGGITPDEKYEVPKLDRFEIGLFRNGLFDFTRSYFGAHSAASLSKTWMPDDQVLNELKAHLRSKGTVFTDAEFNKDREWIKRNLAREMYTSAFNVDESDAMFARTDPEVEKAVEMMPKAAALAESAKKIIVQRMAGQGR

SEQ ID NO: 9050 - protein, 116 aa, Zea mays
  misc_feature (40)..(40): Xaa can be any naturally occurring amino acid
  misc_feature (43)..(43): Xaa can be any naturally occurring amino acid
  misc_feature (65)..(65): Xaa can be any naturally occurring amino acid
MADACLIEGNALLPPEVNWLLYLRNLPFNISGEEMYDIFXSTXSSRQIRLDNVIDTRVTAYFFYXDIYDSKNAVYHLSCFNLGNRYLIVLYYQPAKMYNKSDLNKKEDEITRLHEK

SEQ ID NO: 9051 - protein, 278 aa, Staphylococcus epidermidis
METVQFYNGRTMPKIGLGTYRVKDGDECRESVKYAIERGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNKLRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFDGK

SEQ ID NO: 9052 - protein, 187 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKVAIGIFYRKKLKPFVI

SEQ ID NO: 9053 - protein, 493 aa, Unknown
  Shewanella sp. MR-4
MSDNQPQAAKHTLMWFRQDLRLTDNQALTAACDWVRQVPGAKLRAIYIATPSQWLSHDMAPIQIDFIQRHVNLLAQGLASLGIEFELIQLDSFKEVPAFLASYCEKLGVERVFAGREPEINEQKRDQACLDVGIPLVLSDEHCLLPPGTVLNLSGDMYKVFTPFSRKWREVAAKRAILPLAVPAPLGPMLPEPKPISFKERFPFTSKLTSSEQWAAGEGQAKRILTAFIQQKAQDYKQDRDFPALEGTSVISPYLALGVLSPRQCIAALLGRFPEVIVDDTSPGRTWLNELIWREFYRHLLVAFPDLSKGHNFNRQADHVQWRNNQAEFLAWCEGKTGYPIVDAAMRQLNQTGWMHNRLRMVVASFLTKHLLIDWRWGERYFRQHLIDGDLAANNGGWQWSAGCGCDAQPYFRIFNPISQSEKFDPDGSFIRKYLPELASWGIKRLHQPNMQKTPSLFEVPTLESDSAYPYAIVEHNAARARALAVLGVLKKA

SEQ ID NO: 9054 - protein, 251 aa, Brassica napus
MNIAHTIFGVFGNATALFLFLAPSITFKRIIKNKSTEQFSGIPYPMTLLNCLLSAWYGLPFVSKDNTLVSTINGTGAVIETVYVLIFLFYAPKKEKAKIFGVFTAVRAVFATVALVSLFALHGNGRKLFCGIAATVFSIIMYASPLSIMRLVVKTKSVEYMPFFLSLFVFLCGTSWFIYGLIGRDPFVAIPNGFGCALGTVQLILYFIYCGNKGDKSTDDAEKDEKKTVEMKDEEKKKQNVVNGKQQEQQV

SEQ ID NO: 9055 - protein, 353 aa, Triticum aestivum
  misc_feature (151)..(155): Xaa can be any naturally occurring amino acid
  misc_feature (163)..(163): Xaa can be any naturally occurring amino acid
  misc_feature (171)..(171): Xaa can be any naturally occurring amino acid
  misc_feature (205)..(205): Xaa can be any naturally occurring amino acid
  misc_feature (212)..(212): Xaa can be any naturally occurring amino acid
  misc_feature (216)..(217): Xaa can be any naturally occurring amino acid
  misc_feature (220)..(221): Xaa can be any naturally occurring amino acid
  misc_feature (224)..(224): Xaa can be any naturally occurring amino acid
  misc_feature (231)..(231): Xaa can be any naturally occurring amino acid
  misc_feature (234)..(234): Xaa can be any naturally occurring amino acid
  misc_feature (258)..(258): Xaa can be any naturally occurring amino acid
  misc_feature (264)..(264): Xaa can be any naturally occurring amino acid
  misc_feature (274)..(274): Xaa can be any naturally occurring amino acid
AYLGDTIEQVCTKKQAGTGPEFPGYRRPTRPESDALGWQYISGSLPDSRELDHIDNPQLEGYKFDPHGEYVRRWLPELARLPTEWIHHPWDAPASVLQAAGVELGSNYPLPIVELDTAQVRLQEALSEMWQLEAASRAEWTLMRAASQSQXXXXXCPNRVSLXDLQMEVHXEPARVAPNVLTTAQRRQDQMVPTHDTSLNRVETXEISADLXNSVXXLTXXCVXSACIVEXTDXRGEGIDSKPGPMHAGPNGFPHPNXFQQPLXRRRNFLAPSXVSEASSSWTRGDGGVVPVWSPPAASGHSQTYGADEADVSSRSYLDRHPQSHRIMNWHQLSQSLTTGKDVENSVQPNFIG

SEQ ID NO: 9056 - protein, 279 aa, Glycine max
MENRTSSVLPPGFRFHPTDEELIVYYLCNQATSRPCPASIIPEVDIYKFDPWELPEKTDFGEKEWYFFSPRERKYPNGVRPNRATVSGYWKATGTDKAIYSGSKHVGVKKALVFYKGKPPKGLKTDWIMHEYRLIGSRRQANRQVGSMRLDDWVLCRIYKKKNIGKSMEAKEEYPIAQINLTPANNDSEQEMVKFPRTSSLTHLLEMDYLGPISHILSDATYNSTFDFQINTANGGIDPFVKPQPVEIPYAADSGKYQVKQNSTINPTIFVNQVYYQRG

SEQ ID NO: 9057 - protein, 692 aa, Cryptococcus neoformans
MSQMLNQAANMVTGDAKYRQMAEYTIDQDDKTPYTTYFGVKVSDTDNSLRAGARGPTLLEDFHNREKIQHFDHERIPERVVHARGAGAFGEFKLHTPLTGITTAKVLTDTSKVVPAYVRFSTVAGSRGSADTVRDVRGFATRLYTDEGNWDIVGNNIPVFFINAQTAHDNAWDFMSLHKPALHMQQWITSDRAIPRSYRMMQGFGVHTFRLINEEGKSTFVKYHWIPHLGTHSLVWDEALKIAGQDPDFHRRDLWDAIEAGTYAKWDLGVQLIKEEDEHKFDFDLLDATKLIPDELVPVQKIGTLTLNRNPVDYFSEVEQVAFCTQHIVPGMDFTDDPLLAGRNFSYPDTQVSRLGINWKHIPVNRPVCPFMTTMREGQMSMFSKNNRTPYHPNRNENLPLTSPKEGGFKSYPAKVSGIKERVQAPKFNDHSSQATLFWNSMSDVEKKHIIDAYKFELSHCTDNLVIQNVINCINEIDHGLATAVHSGFPHLSLPEAKPNHGKRTEYLSQITGKNQIFTAAGRKIGIFLVPGYVYSQVAPLLAAFKAAGCMVKFVGPTLGPVEASDGQSFTTEFTFEGCRSTYFDALIFAGGPDNAFLSKLKVGRLIHAAREAYMHLKAVGAVGNATQWLVDTCLPGEFSPKVKTESSVVQENGVVFAPINPTLHSAQFAKQFLDGVANHRVWDREVSHIAA

SEQ ID NO: 9058 - protein, 714 aa, Cryptococcus neoformans
MAQMLNQAVTAVTGDAKYRQMAENTIEQTSKTPLTTYFGVKVPETDVALRAGARGPTLLEDFHNREKIQHFDHERIPERVVHARGSAAHGEFKLHTPLTGITTAKVLTDTSKVVPAYVRFSTVVGSRGSADTVRDVRGFATRFYTDEGNWDLVGNNIPVFFIQDAIKFPDVIHALKPEPHNEMPQAQTAHDNAWDFISLHQQATHMQQWVTSDRAIPRSYRMMQGFGVHTFRLINEEGKSTFVKYHWIPHLGIHSLVWDEALKIAGQDPDFHRRDLWDAIEAKAYPKWELGVQLIKEEDEHKFDFDILDSTKIIPEELVPVQKIGTLTLTRNPVDFFAEVEQVAFCTQHIVPGMDFTDDPLLAGRNFSYADTQISRLGTNWHDLPINRPICPVMTNFRDGQMSMFSKTNRTPYHPNRHDSLPLTSSNNGGFQSYREKISGVKERLNGPKFQEFYSQATLFWNSMSETEREHIIAAYNFELSHCAEDIVIQNVINSLNEIDHGLATSVHATFPHLTLPEAKPTHNKKSEYLSQINGKHQVFTASGRRIGIYLVPGYTYSQVVPLLAAFEADGCMVKFIGPTLGPIKASNGQSFTAEFTFEGCRTTFFDAIVFVGGPDDSFIAKLKIGRLIHAAREAYMHLKPIGVLGNATQWMVNTCLPGDFSEKTKTESSVVVENGVVFAPGDPTLHSIKFAKQFLEGVAHHRVWDRQVAHIAA

SEQ ID NO: 9059 - protein, 339 aa, Synechococcus elongatus
MAQSTTSETHTRDLDRDCTTLSRHVLEQFQSFSPEAQDLAALMQRIGLAAKLIARRLSHAGLVDDALGFTGEINVQGEASKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFCSGPKVSPVHPGNASPRRLQRRYSGALVADFHRILMQGGVFLYPETVKNPTGKLRLLYEAPPMAFLAEQAGGKASDGQKPILLRQPQALHRRCPLIIGSAADVDFVDSLLG

SEQ ID NO: 9060 - protein, 120 aa, Cryptococcus neoformans
MQRPNDSLAQRALFVKNLNFNITGADLYDLFGKYGPIRQIRLGTDANLKTKGTAYVVFESPDDAKEAVNQLNGFHLMERYIVVLYHHPSKQQASALAKAELRAREEALAEEKRRLGMKDE

SEQ ID NO: 9061 - protein, 278 aa, Streptomyces avermitilis
MSTKVPPITLNNGVEMPQLGFGVWQVPDDEAERAVATALEAGYRSIDTAAIYGNEEGTGKAIATAGIPRADLFVTTKLWNSDQGYDSTLRAFDVSLEKLGLDYIDLYLIHWPLPTRGQFVETYKAFEKIYADGRAKAIGVSNFLPEHLRTLIDATSVIPAVNQIELHPHLQQHAAREFHAEHGIATEAWSPLGSGKGLLEVPAIVAIARKHERTPAQVVLRWHIQLGNIVIPKSVTPSRIKENIEVFDFSLDDEDIAAISALNEDRRLGPDPATFDMG

SEQ ID NO: 9062 - protein, 289 aa, Triticum aestivum
  misc_feature (231)..(231): Xaa can be any naturally occurring amino acid
  misc_feature (253)..(253): Xaa can be any naturally occurring amino acid
MGEQKGNILMGKYEMGKMLGQGTFAKVYHARNIETSQSVAIKVTDKEKVLKGGLTDQIKREISVMKLVKHPNIVQMYEVMATKTKIYFVLEHVKGGELFNKVQRGRLKEDAARKYFQQLICAVDFCHSRGVYHRDLKPENLLLDENSNLKVSDFGLSTISECRRLDGLLHTSCGTPAYVAPEVINRKGYDGAKADIWSCGVILFVLLAGYLPFQDKNLMNMYKKIGKAEFXCPSWFSSDIRRLLLRILDPNPXTRISIERIMEHPWFRKGLDAKLLRYNLQAKDAGSCC

SEQ ID NO: 9063 - protein, 373 aa, Arabidopsis thaliana
MAKEIESATDLGDTNIKGVLVHGGRYFQYNVYGNLFEVSNKYVPPIRPIGRGASVLSVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANARKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 9064 - protein, 476 aa, Bacillus thuringiensis
MQNKIIVMFQKDFRLYDNPALFEAAQSGEVVPVYVHDETFSMGSASKWWLHHAIIDVKKQLEALGSTLIIRKGSTQEEILSLVEQLGITAVYWNICYDPDRLQFNQKMKMMLEHKGMICKEFNSHLLLEPWVIKKKDNTEYKVFTPFYNAFQKQVIHKPISKVQSIKGGNSLPVSLSVSELHLLPTIPWTSHMESIWEPTEEGAYKTWKEFFSSKLASYSEGRDFPNQNAHSMLAPYLSFGQISVKLIYHYLINKSTESQCSLFEKQVNSFIRQLIWREFSYYLLYHYPFTAYKPLNKSFEHFPWNNEEELLRVWQKGDTGYPFIDAGMRELWQTGFMHNRTRMAVASFLVKHLLIPWQEGAKWFMDTLLDADIANNTMGWQWVAGSGADASPYFRIFNPITQGEKFDKNGEYIREWVPELKDMPNKYIHKPWEAPEHILQKANIQLGHTYPLPVVDHKAARERALCAYKSMKEFV

SEQ ID NO: 9065 - protein, 589 aa, Zea mays
MGSKNLSSSQMIRAPLSLSASRIHAPAPAPSSVAIPASTAPHRTVSAAMRRFAADRARRAVAASLHGAASRSAAPSPHAPAPRHPASPVGAAAMAAAMVRTMSTTAAGTPPVSVATINPKVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGIKGLRDEIAAGIAARDGFHASGDNIFLTDGASPAVHMMMQLLISSESDGILCPIPQYPLYSASIALHGGSLVPYFLNEETGWGLDVDELKKQLEEARSKGITVRALVVINPGNPTGQVLVEENQKKIVEFCKNEGLVLLADEVYQENIYVEDKPFHSFKKIARSLGYTDDDLPLVSFQSVSKGYYGECGKRGGYMEITGFSPDVREQIYKVASVNLCSNVSGQILASLVMNPPKAGDESFESFMSERDGILSSLARRAKALEEAFNSLEGITCNKAEGAMYLFPRLHLPQKAIGAAQAVGTAPDAYYAKRLLEATGIVVVPGSGFGQVPGTWHFRCTILPQEDKIPAIVSRLKEFHEKFMDEFRD

SEQ ID NO: 9066 - protein, 492 aa, Vigna radiata
MDPYKYRPSSAFNSPFWTTNSGAPVWNNNNSLTVGTRGPILLEDYHLVEKLANFDRERIPERVVHARGASAKGFFEVTHDVSHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFSFLFDDLGVPQDYRHMDGFGVNTYTLINKAGKAVYVKFHWKTTSGVKCLLEEEAIKVGGANHSHATQDLHDSIAAGNYPEWKLFIQTIDPEHEDKFDFDPLDVTKTWPEDIIPLQPVGRLVLNKNIDNFFAENEQLAFCPAIIVPGVYYSDDKMLQTRIFSYADSQRHRLGPNYLLLPANAPKSAHHNNHHEGFMNFIHRDEEVNYFPSRYDPVRHAEKFPIPPAVFSGRREKIAIEKENNFKQAGERFRSWAPDRQDRFIRRWVDALSDPRVTHEIRSVWISYWSQADRSLGQKIASHLNMRPNI

SEQ ID NO: 9067 - protein, 544 aa, Agrobacterium tumefaciens
MAAKEVKFGRSAREKMLKGVDILADAVKVTLGPKGRNVVIDKSFGAPRITKDGVSVAKEIELEDKFENMGAQLVREVASKTNDIAGDGTTTATVLAQAIVREGAKAVAAGMNPMDLKRGIDLAVAEVVKDLQAKAKKINTSEEVAQVGTISANGERQIGLDIAEAMQRVGNEGVITVEEAKTAETELEVVEGMQFDRGYLSPYFVTNPEKMVADLEDAYILLHEKKLSNLQAMLPVLEAVVQTGKPLVIIAEDVEGEALATLVVNKLRGGLKIAAVKAPGFGDRRKAMLEDIAILTGGTVISEDLGIKLESVTLDMLGKSKKVSISKENTTIVDGAGQKSDIEGRVAQIKAQIEETTSDYDREKLQERLAKLAGGVAVIRVGGSTEVEVKEKKDRIDDALNATRAAVQEGIVPGGGVALLRSSTKITVKGVNDDQEAGINIVRKALQSLVRQIAENAGDEASIVVGKILDKNEDNYGYNAQTGEYGDLIALGIVDPVKVVRTALQNAASVASLLITTEAMIAELPKKESAMPQMPGGGMGGMDF

SEQ ID NO: 9068 - protein, 820 aa, Oryza sativa
MLCLTSSSSSAPAPLLPSLADRPSPGIAGGGGNVRLSVVSSPRRSWPGKVKTNFSVPATARKNKTMVTVVEEVDHLPIYDLDPKLEEFKDHFNYRIKRYLDQKCLIEKHEGGLEEFSKGYLKFGINTVDGATIYREWAPAAQEAQLIGEFNNWNGAKHKMEKDKFGIWSIKISHVNGKPAIPHNSKVKFRFRHGGGAWVDRIPAWIRYATFDASKFGAPYDGVHWDPPACERYVFKHPRPPKPDAPRIYEAHVGMSGEEPEVSTYREFADNVLPRIRANNYNTVQLMAIMEHSYYASFGYHVTNFFAVSSRSGTPEDLKYLVDKAHSLGLRVLMDVVHSHASNNVTDGLNGYDVGQNTHESYFHTGDRGYHKLWDSRLFNYANWEVLRFLLSNLRYWMDEFMFDGFRFDGVTSMLYHHHGINKGFTGNYKEYFSLDTDVDAIVYMMLANHLMHKLLPEATIVAEDVSGMPVLCRPVDEGGVGFDFRLAMAIPDRWIDYLKNKEDRKWSMSEIVQTLTNRRYTEKCIAYAESHDQSIVGDKTIAFLLMDKEMYTGMSDLQPASPTINRGIALQKMIHFITMALGGDGYLNFMGNEFGHPEWIDFPREGNNWSYDKCRRQWSLVDTDHLRYKYMNAFDQAMNALEEEFSFLSSSKQIVSDMNEKDKVIVFERGDLVFVFNFHPNKTYKGYKVGCDLPGKYRVALDSDALVFGGHGRLAMMWITSRLPRECQEYQKQISTTALTHSKSFPRPVPVWAYYRVDEDREELRRGGAVASGKIVTEYIDVEATSGETISGGWKGSEKDDCGKKGMKFVFRSSDEDCK

SEQ ID NO: 9069 - protein, 609 aa, Rhodopirellula baltica
MDSPRPAIPLQRHSRWNRRMDLLTTINRCLAFDKQADQSNEGKAIAKHARRRRVAGRMRTFALVVGAIAVGGSSMPAFAQGFVPSRGPTVSAPTNDAERKLEEQERARALTDGIELEDAGQWSDAIDHYESATRRFPQDRILYQRLLISRLRFDVNRRYQDQTYLRSLRDMTTSQSLDLYSEILANLQTHYVDTIEWSRVLLHGTAALETALDDETFVQTMLPNATPEQIEKFRMEIHHRISQRSTQSRFDLRATVSQVASMAQQELGLSGTATVLEFVSGAVSTLDTYTRLLSPGQLDDMFSTIDGNFVGLGVELKPGEDCLNILSVIPGGPADEAGIVAGDRIMGVDAISAADRDPDYVADLLRGPEGSLVSLEIASVDQQPRSIRVARRRVDVPCVENIHLVDTDAKIGYFRLTNFQKSTPAEVEKALWALSRQGMRSLIIDLRDNPGGLLPASVEVADRFIDNGRILTTRGRNARENFDYSAHRANTWNVPLAVLIDRNSASASEIFSGAIRDSNRGTVVGEKSYGKGSVQGIFRMQAAQFGLCLTTAKFYSPSGRAISRNGVEPHLSVPPTYIAARPDENGRLVTELEDDVLQRAIEHLAQPAH

SEQ ID NO: 9070 - protein, 265 aa, Cucumis sativus
GIMQMGLAENQLSFDLLESWLTKNPDAASFKRDGKSIFRELALFQDYHGLPAFKKALVEFMAEIRGNKVTFEANNIVLTAGATSANETLMFCLAEAGDAFLLPTPYYPGFDRDLKWRTGVEIVPIHCTSSNGFQVTQPALEQAYQEAQARNLRVKGVLVTNPSNPLGTTMTRNELDLVFDFITSKGIHLISDEIYSGTVFGSPGFVSAMEVLKERSNEDEEVWKRVHIVYSLSKDLGLPGFRVGAIYSNDEMVVAAATKMSSFAL

SEQ ID NO: 9071 - protein, 1013 aa, Arabidopsis thaliana
MKFIYNPTLRHVTVCVIKSKAFLANNGRKTTRVGMDHPDPIRKRYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 9072 - protein, 101 aa, Manihot esculenta
MATLGGIKEVEESANSVEIDNLARFAVDDYNKKQNALLEFKRVVSTKQQVVAGTMYYITLEVADGGQTKVYEAKVWEKPWLNFKEVQEFKPIGVAPSDSTA

SEQ ID NO: 9073 - protein, 481 aa, Pseudomonas aeruginosa
MNGLPMNLIWFRCDLRTTDNSALLAAADGRPCLALYLLSPAQWREHDDAPCKVDFWLRNLGELQRQLAALNIPLLVRDCGHWRQAPEVIGRLCRELGVGAVHVNQEYGVNEERRDQAVGQRLREQGVAFHSHLDQLFFAPGSVLTRTGGYFQVFSQFRKVCHERLYQALPGVRPRPQPQPPHALASDPLPDAVPAFPRPADSLRRLWPAGEEVAQERLRDFADQHLADYHERRDFPALPGTSQLSPYLAAGVLSPRQCLDAALVANRGEFSGGQQGAATWINELLWREFYKHILVGYPRVSRHRPFREETEALRWRQAPAELEAWQQGRTGIPIIDAAMRQLLATGWMHNRLRMVVAMFLSKNLLIDWREGERWFMRHLIDGDLAANNGGWQWSASTGTDAVPYFRLFNPLSQSERFDPRGEFIRHWLPELAGLERKAIHDPSSLGLFAGVDYPRPMVDLKASRERALAAFRNLPPRDGRA

SEQ ID NO: 9074 - protein, 274 aa, Glycine max
MHVSNGRQWLPTPEAADGLQSELPFEFQVLEIALEAVCTYLDSNVGDLERGAYPVLDELARNVSTKNLEHVRSLKSNLTRLLARVQKVRDEIEHLLDDNEDMAQLYLTRKWLQNQQFEEAHLGATTSNNFPNTSRSVRRLGSNRSESLVTCHYEDDNNVEDLEMLLDAYFMQLDGTRNKILSVREYIDDTEDYVNIQLDNHRNELIQLQLTLTIASFAIAIETMIAGAFGMNIPCNLYHIDGVFWPFVWITSAACVLLFLLILAYARWKKLLGS

SEQ ID NO: 9075 - protein, 357 aa, Streptomyces coelicolor
MTSLFDSYRLGELTLPNRMVMAPMSRVRAAGGGLATPSMATYYAQRATAGLIVSEGVQPNEVGQSNPGTPGLHTDEQVAAWRPVTAAVHTNGGRIFAQIMHGGRVSHPDTTGMLPVGPSAVPAVGEVFTPTGPQPVPTPRALETAEVPEQARSYAEAARRAVDAGFDGVELHGANGYLISQFLSTNANLRTDRYGGPVAHRIRFAVEAVSATVEAVGADRTGIRLSPAGTFWGVEETDVLDLYTELLTELSRLGIAYVHIEATADEELLVALRRVWPGTLVMNPVLPMGPKQTGREDADHWLGLGADLISFGRGFIANPDLVERLRTGLPVAPVDESTYYQGGDAGYLTYPAYQHTV

SEQ ID NO: 9076 - protein, 277 aa, Bacillus cereus
MSLTSLKDYTTLHNGVKMPWFGLGVFKVEDGSEVIESVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 9077 - protein, 231 aa, Zea mays
MVAGLEDPAIDPTALSLALPASAPALNKEDYIAICLAALAGTRKFGLGREKDQHQHTKWCPTTTTTHAPSAQQELRFRCAVCGKAFATYQALGGHKSSHRKPTTPERYAAALAAAATTTAARGDHSDETTASSLSGSAASGGPHRCSICRRGFATGQALGGHKRCHYWDGMSVSISVSSGMASSSGLSTVRNFDLNLAPLPENGDAGMMKRWAEEEEVQSPLPIKKRRMSD

SEQ ID NO: 9078 - protein, 408 aa, Unknown
  Malus x domestica
ALGEDSPYFAGWKAYDENPYHESSNPSGVIQMGLAENQVSFDLLEKHLEENSEASNWGSKGTKGVSGFRENALFQDYHGLLSFRKAMANFMEQIRGGRAKFDPVRVVLTAGATAANELLTFIIADPGDALLVPTPYYPGFDRDLRGRTGVNIVPIHCESSNNFQITPQALEAAYKEAEAKNMRVRGVLITNPSNPLGATIQRAVLEEILDFVTQKNIHLVSDEIYSGSAFSSSEFISVAEILEDRQYKDAERVHIVYSLSKDLGLPGFRVGTVYSYNDKVVTTARRMSSFTLISSQTQHLLASMLSDKEFTGNYIKTNRERLRTRYDMIVQGLKKSGIECLKGNAGLFCWMNLSPFLDEPTRECELTLWDSMLHEVKLNISPGSSCHCSEPGWFRVCFANMSEQTLEG

SEQ ID NO: 9079 - protein, 365 aa, Aspergillus oryzae
MAEFVRAQIFGTTFEITSRYTELQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAACIFAEMLEGKPLFPGKDHVNQFSIITELLGTPPDDVIETICSENTLRFVKSLPKRERQPLATKFKNADPDAVDLLERMLVFDPKKRIRAGEALAHEYLAPYHDPTDEPVAEEKFDWSFNDADLPVDTWKIMMYSEILDFHNIDQGTEASQVLVEGAGDAQQNFV

SEQ ID NO: 9080 - protein, 506 aa, Streptomyces coelicolor
MTDTPPATTTDSGAPAESDEHSLTAGPAGPVLLQDAYLIEQMAQFNRERIPERQPHAKGSGAFGHFEVTHDVSAYTKAAVFQPGTRTDLVARFSTVAGERGSPDTWRDPRGFAVKFYTSQGNYDMVGNNTPVFFVKDPMKFQHFIRSQKRRADSNLRDHDMQWDFWTLSPESAHQVTWLMGDRGIPRTWRHMNGYTSHTYMWINASGERFWVKYHFKTDQGIEYFTQHEADQMAAADTDYHMRDLFEHIRDGDFPSWTLHVQVMPYEEAAGYRFNPFDLTKVWPHGDYPLIPVGRMTLERNPTDNHAEIEQAAFQPNNLVPGIGPSPDRMLLARLFSYADAHRYRIGANYQQLPVNAPVVDVRTYSKDGAMAYRKTTDPVYAPNSKGGPAADTEHFGTPPSWETDGSITRTAYVSHAEDDDWGQPGTLVREVMDDAARDRLVDNVVDHLLNEVTEPVLQRAFAYWSNIDRTIGDRIAKGVRAKAGEKDFKAAEQRNPARQAMQDKA

SEQ ID NO: 9081 - protein, 372 aa, Unknown
  Comamonas sp. NCIMB 9872
MKKVFDLFDLKGLKLRNRVVMAPMSRARILDSTPDSSTALYYGQRAGAGLIIAEGANVSPQACGTMGTAGIYLPEHVAGWRLTTQAVHTAGGRIFLQLAHAGRVSHRSLQPEGAAPVSSTSKHALNTTVFGINAAGHTAPLQTSMPQCLTEQELAGIRSDFVRAARLAMQAGFDGVEIHAGNGFLFEQFINGALNDRQGLYGGAPAAHRLRFLLETLDAVASAIGPDHVGVKVTPFSRLADMPSYEGETQTWLAFANEPLLGSLAYVHAAFGDVDASFALQFRQALRGTLMRPCSPDAAAANAMLEQGLADLVVMGRPFISNPDLVERMRHGWPLSLASDTTVYGGGSAGYTDYPFYKPAQEADNSSADALV

SEQ ID NO: 9082 - protein, 314 aa, Coccidioides posadasii
MASRHTTFRLNTGEDIPAIGFGTWQDENAQEDAVLTALSAGYRHIDTAAVYGTEKAIGRALARSRLSRDELFITSKLWNNKHRPEDVEQAIDQSLKNLEIDYLDLYLMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPALAAIGTKYGKTGAQVALAWGITKGHSVLVKSKTPHRIQQNFESDFELKQEDMKAIENIDKKLRFNDSSADFGYNFFVGLEGKEK

SEQ ID NO: 9083 - protein, 214 aa, Glycine max
MGQQSLIYSFVARGTMILAEHTDFSGNFAEVALQCLQRLPASDNKFTYNADGHTFNYLTYNGFTYCVVAVESVGRQLAMAYLERIMEDFSKRYGGGKATTATAKSLNKEFGSKLKEHMQYCVEHPEEVSKLAKVKAQVSEVQQVMRANIDQVLDRQVKIDVLVGQTEDLRNQAGVFRERGDQIRRKMWYQNMKIKLIVLAIVIAIILIIVLLVT

SEQ ID NO: 9084 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRYGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 9085 - protein, 469 aa, Unknown
  Frankia sp. CcI3
MPRSGTALGDRTGISRSGRTSTQPSSSESLPRGELAGTPPTGRKSAGQPTYPGQMEFTQSDKLADVCYDVRGPVLDEATRLEAAGSRILKLNIGNPAPFGFSAPPEVLEAVVANLADAQGYSDSKGLLAAREAVVRYHLRKGVTGIDPGGVYLGNGVSELIMMSLQALLNNGDEVLLPAPDYPLWTAVVSLCGGRPVHYLCDESAGWAPDLDDIAAKVTPRTRAIVVINPNNPTGAVYDRQVLENIVEVARRHHLMLLSDEIYDRILYEDAEHIATAALAPDLVCMTFNGLSKSYRLAGFRAGWMVMSGPRGHASSYIEGVNILANMRLCANAPGQFATVAALTEDGGAGDLVLPGGRLREQRDTVVKLLNDIPGVSCVPPRGALYAFPRLDPAVYPIRDDERFVLDLLLAEKILLVQGSGFNWPHPDHVRIVTLPAVDDLTDAIGRIDRFLASYKRPSQQQCPSQRRN

SEQ ID NO: 9086 - protein, 493 aa, Oryza sativa
  misc_feature (405)..(405): Xaa can be any naturally occurring amino acid
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHQPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDTLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPXPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 9087 - protein, 630 aa, Aquifex aeolicus
MKKFSLISDYDVYLFKEGTHTRLYDKLGSHVIELNGKRYTFFAVWAPHADYVSLIGDFNEWDKGSTPMVKREDGSGIWEVLLEGDLTGSKYKYFIKNGNYEVDKSDPFAFFCEQPPGNASVVWKLNYRWNDSEYMKKRKRVNSHDSPISIYEVHVGSWRRVPEEGNRFLSYRELAEYLPYYVKEMGFTHVEFLPVMEHPFYGSWGYQITGYFAPTSRYGTPQDFMYLIDKLHQEGIGVILDWVPSHFPTDAHGLAYFDGTHLYEYEDWRKRWHPDWNSFVFDYGKPEVRSFLLSSAHFWLDKYHADGLRVDAVASMLYLDYSRKEWVPNIYGGKENLEAIEFLRKFNESVYRNFPDVQTIAEESTAWPMVSRPTYVGGLGFGMKWNMGWMNDTLFYFSKDPIYRKYHHEVLTFSIWYAFSENFVLPLSHDEVVHGKGSLIGKMPGDYWQKFANLRALFGYMWAHPGKKLLFMGGEFGQFKEWDHETSLDWHLLEYPSHRGIQRLVKDLNEVYRREKALHETDFSPEGFEWVDFHDWEKSVISFLRKDKSGKEIILVVCNFTPVPRYDYRVGVPKGGYWREIMNTDAKEYWGSGMGNLGGKEADKIPWHGRKFSLSLTLPPLSVIYLKHEG

SEQ ID NO: 9088 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 9089 - protein, 246 aa, Brassica napus
MNIAHTIFGVFGNATALFLFLAPSITFKRIIKNKSTEQFSGIPYPMTLLNCLLSAWYGLPFVSKDNTLVSTINGTGALIERVYVLIFLFYAPKKEKAKIFGVFTAVLAVFATVALVSLFALHGNARKLFCGIAATVFSIIMYASPLSIMRLVIKTKSVEYMPFFLSLFVFLCGTSWFIYGLIGRDPFVAIPNGFGCALGTLQLILYIIYCGNKGEKSAEKDDKSLEMKGEEKKQNVVNGKQQEQQV

SEQ ID NO: 9090 - protein, 686 aa, Pseudomonas fluorescens
MAFEAMFQPIQIGKLTIRNRVLSTAHAEVYATDGGMTTERYVKYYEEKAKGGIGLAICGGSSVVAIDSPQQWWSSVNLSTDRIIPHFQNLADAMHKHGAKIMIQITHMGRRSRWDGFHWPTLMSPSGIREPVHRATCKTIEPEEIWRVIGNYAQAARRAKAGGLDGVELSAVHQHMIDQFWSPRVNKRTDEWGGTFEGRMKFGLEVLKAVRAEVGDDFCVGMRICGDEFHPDGLSHEDMKQIAKYYDDTGMLDFIGVVGSGCDTHNTLANVIPNMSYPPEPFLHLAAGIKEVVKVPVLHAQNIKDPNQATRILEGGYVDMVGMTRAHIADPHLIAKIKMGQIDQIKQCVGANYCIDRQYQGLDVLCIQNAATSREYMGVPHIIEKSTGPKRKVVIVGAGPAGMEAARVAAERGHDVTLFEKKEFIGGQITTASKAPQRDQIAGITRWFQLELARLKVDLRLGTAADADTIMDLRPDIVVLAVGGHPYLEQNEHWGAAEGLVVSSWDVLDGKVAPGKNVLVYDTICEFTGMSVADFLADKGSQVEIVTDDIKPGVAIGGTSFPTYYRSMYPKEVIMTGDMMLEKVYREGDKLVAVLENEYTGAKEERVVDQVVVENGVRPDEEIYYALKDGSRNKGQIDVEALFAIQPQPSLSSTGDGYLLFRIGDCVAQRNTHAAIYDALRLCKDF

SEQ ID NO: 9091 - protein, 272 aa, Saccharophagus degradans
MNMQLGSPVSVHPIPIYQGNYVWVMRHTSQNSVVVVDPGSASEVIEYITQHELTIASIIITHSHWDHVTGIAELCANLQLWRDEEPVVYGPSVIQDVTHPVEDGDRIELCKGVDVPSLQVIATPGHMPEHLSYLLPLTTPKLFCGDTLFSCGCGRILQGTHEQLRTSLDAISALPSQTEVYCTHEYTLTNIKFARTVEPQSQALIDYEQRVRSLRKNDLPSIPTTIEREKALNPFLRYKELSIQQAVENHLRLKGLTAADVFKHLRLWKDSF

SEQ ID NO: 9092 - protein, 283 aa, Tropheryma whipplei
MVVFVLTYVPSVLLGDGVSIPQFGLGTYELPPNEASSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHIDKIKEAGFPLPSVNQIELHPWLQQRELVLSCRNDGIQIESWGPFARFSKDLDAFPELTRPAKQYGKTPAQVILRWHIQKGYVVFPKTVHAERLRQNIDIFDFDLTPDEISGIDSLDAGFRTGPDPSSFRAGLD

SEQ ID NO: 9093 - protein, 477 aa, Lycopersicon esculentum
NSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 9094 - protein, 485 aa, Lycopersicon esculentum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 9095 - protein, 457 aa, Streptomyces avermitilis
MNVSVVLFTSDLRLHDHPPLRAALDGARQVVPLFVRDRAVDGAGFAAPNRLAFLADCLRDLDAGLRERGGRLVLRSGDVVDQVCKVAAEADADEVHLAAGVSAYAHRREQRLRSALEADGRRLHVHETVITAVAPGAVTPSSSDHFAVFTPYFRHWEREHLRDALGAPRGVRVPESVGSERLPTRTELSGLSQGLAAGGEEEGRKRLMAWLRGGITAYEDRHDDLAGDATSHLSPHLHFGTLSPVELVHRARRTGGPGAEAFVRQLAWRDFHYQVLAARPDAATADYRGRGDRWRSEAAAREEVEAWRTGRTGYPVIDAAMRQLRHEGWMHNRGRLLTASFLTKTLYVDWRVGARHFLELLVDGDVANNQLNWQWMAGTGTDTRPNRVLNPVTQAKRYDPDGAYVRRWVPELEGLRGAAVHEPWKLKGLDRAAYDYPDPIVELADGLARFRHARGRD

SEQ ID NO: 9096 - protein, 472 aa, Escherichia coli
MTTHLVWFRQDLRLHDNLALAAACRNSSARVLALYIATPRQWATHNMSPRQAELINAQLNGLQIALAEKGIPLLFREVDDFVASVEIVKQVCAENSVTHLFYNYQYEVNERARDVEVERALRNVVCEGFDDSVILPPGAVMTGNHEMYKVFTPFKNAWLKRLREGMPECVAAPKVRSSGSIEPSPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLITYHPSLCKHRPFIAWTDRVQWQSNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDHEGEFIRQWLPELRDVPGKVVHEPWKWAQKAGVTLDYPQPIVEHKEARVQTLAAYEAARKGK

SEQ ID NO: 9097 - protein, 485 aa, Lycopersicon esculentum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMVGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 9098 - protein, 391 aa, Acorus gramineus
PYEVPMTAAGALQSYKLAAKAIARLQSLPGGSMERLCDTMVREVFELTGYDRVMAYKFHEDDHGEVVAEITKQGLEPYLGLHYPATDIPQAARFLFMKNKVRMICDCRAKPVKVFQDEKLTIDLAFCGSTLRAPHSCHLQYMENMDSIASLVMAVVINDGDDDDDHVGDNNNDNSKKKRLWGLVVCHNTSPRFVPFPLRYACEFLTQVFAIHVHKELELENQMPEKNILRTQTLLCDMILRDAPLGIVSQTPNIMDLVKCDGAALLYKDKIWQLGTTPTERQIRDIAIWLTDYHMDSTGLSTDSLHDAGYPDALALGDVVCGMAAARITSKDILFWFRSPTTSEIQWGGAKHERSDQDDGRRMHPRSSFKAFLEVVKTRSLPWKDYEMDAI

SEQ ID NO: 9099 - protein, 407 aa, Acorus gramineus
ILHRIDVGLVIDLEPVNPSDVPVTAAGALKSYKLAAKAISRLQSLPSGNISLLCDVLVREVSDLTGYDRVMVYKFHEDEHGEVIAEQRKTDLEPYLGLHYPATDIPQASRFLFMKNKVRIICDCFTPPVKVVQDKKLGQPLSLCGSTLRAPHGCHAQYMANMGSIASLVMAVTINDDDDDDGNGNEQQQKGRKLWGLVVCHHTSPRFIPFPLRYACEFLIQVFSIQLNKEVELAAQMREKHILRTQTVLCDMLLRDAPVGIFTQSPNVMDLVMCDGAALYYKNQFWLLGTTPSEVQIKDLVDWLHECHNGSTGLSTDSLMEASYPGASALGNAACGMAAIKIGGTRDYMFWFRSQTAKEIKWGGAKHDPVDNDEEGQKMHPRSSFKAFLEVVKWRSLPWENAEMDAI

SEQ ID NO: 9100 - protein, 385 aa, Amborella trichopoda
PYEVPMTAAGALQSYKLAAKAISRLQSLPSGNIDRLCHTVVQEVHELTGYDRTMAYKFHEDDHGEVISEITKGGLEPYLGLHYPATDIPQAARFLFMKNGVRMICDCRARHVRVFQDEKLASDLTLCGSTLRAPHSCHLQYMENMDSIASLVMAVVVNEDEEENIADGPKRKRLWGLVVCHNTSPRFVPFPLRYACEFLMQVFAIHVNKEVELEALVREKNILRTQTMLCDMLLRDALLGIVTKNPNVMDLVKCDGATLLYENKLWRLGVTPSEVHIRDLARWLSEYHTDSTGLSTDSLVEAGYPDGVSLGDLVCGMAAVKITETDMLFWSRSHTASEIRWGGAKHDPNDKDDKRRMHPRSSFKAFLEVVKTRSFPWKDYEMDAI

SEQ ID NO: 9101 - protein, 394 aa, Amborella trichopoda
DLEPVNPADVPVTAAGALKSYKLAAKAISKLQSLPSGNIELLCDVLVREVRELTGYDRVMAYKFHEDEHGEVVAEYRRADLDPYLGLHYPATDIPQASRFLFLKNKVRMICDCTASPVKVIQDKKLDKPLSLCGSTLRAPHGCHAQYMANMGSIASLVMSVTINENDEDSSPNEPSFHKGRKLWGLVVCHHTTPRFVPFPLRYACEFLLQVFGIQLNKEVELAAQLREKHILRTQTVLCDMLLRDAPVGIVTQSPNIMDLVKCDGAALYYQKQVWLLGTTPLEAQIRDISGWLLEYHCGSTGLSTDSLMEAGYPGALALGDAVCGMAAVKITSKDFLFWFRSHTAKVIKWGGAKHDPVDRDDGRKMHPRSSFKAFLEVVKQRSLPWEDVEMDAI

SEQ ID NO: 9102 - protein, 727 aa, Xanthomonas axonopodis
MTYNVSSCMKAGLLALVLTTPMALLARADTALPAAATPDQATATKLVYGLLSDSRYAYRPRTLDEAMSKDVFKRYLETLDGGKQFFTQADIDSFAPLQAGVGDALRGGNLEPAFKVFSVYKKRVDQRVKYARDLLKQDFDFSGNDKFEYDRKDVPWAADDKQLDVLWRQSVMNDWLRLKLAGKKPDDIRKTLDKRYVALADSVKQLKGEDVFQFFVNAYTNAVDPHTDYFTPRTAETFNQQMSLSLEGIGAQLQKQDDMVVIREVIPGGPAAVDGTLKPGDRIVGVGQAKSGAIEDVIGWRIDDVVAKIRGSKDTQVRLEYIPAESGIDGKHRTVTLTRQKVRLAEQAAKGETITLPATGSEPQRRIGIIKLPGFYQDFEGRRRNAADYASATRDVAKLLAGFKTDKVDGVVLDLRNNGGGSLDEAIELTGLFIEQGPVVQVRESGGRVTVNGDSDPKVAWDGPLAVLINRGSASASEIFAGAIQDYGRGLVIGETSFGKGTVQNIVDLDRWPAAEGQRYGQVKLTIAQFFRVSGSSTQHKGVVPDIAFPASVDATEFGESTYDNALPWTRIAAAPHTQYGNFAALLPKLQALHTARIASDKEFQWWEEDVKQFRDEKAKKYISLNEAERVAERQKQDQQRKDRQQIRKQLGLPLDPLAEDSDDGLTGNERDIVKDTAREKAAEKRPDPLLHESAAILADALGLLSQDKPLSAQVLPKSTSPGRWAD

SEQ ID NO: 9103 - protein, 240 aa, Arabidopsis thaliana
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 9104 - protein, 642 aa, Zea mays
FCFALQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAEKAQYVKFHWKPTCGVRCILTHEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 9105 - protein, 116 aa, Triticum aestivum
MSSRGGKLAPEVNRALFVKNLSYNVTPEELFDLFGKFGPIRQVRQGIANNTKGTAFVVYEDVTDAKQACDKLNGFNFQNRYLVVLYHQPDKMAKSKEDLEARRESLAQLKQQHGID

SEQ ID NO: 9106 - protein, 479 aa, Schizosaccharomyces pombe
MTAPSATAFSSATTQPTTEGNASMRKRTIPVVPSVPERKWDPKAPKHIQEQPWTMQNWWRHLNWLHCMLIFGLPMIAIYGVFTTPLQTKTLIFAIIYYAYSGLGITAGYHRLWSHRAYKAKKPLEYFLAAGGAAAFEGSIRWWSRDHRAHHRYTDTDKDPYNVKKGFWYAHVGWMIILQNPRRIGRSDVSDLNSDPFVMFNHRHFLPIASFMAFIFPSLFCGLLWGDYRGGYFYAGVCRLVFVHHATFCVNSLAHLIGSQPFDDTNSARNHFITALVTLGEGNHNYHHAFPNDYRNGLRWYEYDPTKIFIYIASLFGLAYNLNTFPDNEIQKGIVQQKQKVLDRWRAKLNWGIPLEQLPVMEFEDFLEQSKTRPLVLINGVVHDMTGFEHPGGQGLLRSAFGKDATAAFNGGVYDHTNGAHNLLSTYRVAVVRGGMEVEVWKSGAGAQLPMKDTQGQKIVRVGEQITRIQPPIEAAAAN

SEQ ID NO: 9107 - protein, 545 aa, Piscirickettsia salmonis
MSAKEVRFGTGSRQKMLDGVNLLANAVKVTLGPRGRNVILEKSFGAPTITKDGVSVAKEIELSDKFENMGAQMVKEVASKSNDDAGDGTTTATVLAQAIIQEGVKSVAAGMNPMDLKRGIDKATIAAVAALKDLSTPCTDNKAIAQVGTISANSDEEIGSIIAKAMEKVPTDGVITVEEGSSLENELDVVEGMQFDRGYLSPYFVNKQEKMIAEIESPFILLVDKKISNIRELLPTLESVAKSGKPLFIIAEDVEGEALATLVVNNIRGIVKVCAVKAPGFGDRRKAMLEDIAILTGGTVISEEVGLDLEKATLEHLGTAKRIVVTKDNTTVIDGAGEQNAIEARVTQIRAQVEETSSDYDREKLQERVAKLSGGVAVIKVGAATEIEMKEKKDRVDDALHATRAAVEEGVVPGGGVALVRAMAAVKALDFANDEQAQGANILLRAMSAPLRQIVENAGSEAAVILDKIVNGEGNFGYNAATNEFGDMIEMGILDPTKVTRSALQNAASIAGLMITTEAMVAELPKEDSAGGAGMPDMGGMGGMM

SEQ ID NO: 9108 - protein, 137 aa, Zea mays
YRVVGSVAALLLLLAIVVPFTQTQTQSARDKAAMAEDAGPLVGGISDSPMGQENDLDVIALARFAVSEHNNKANALLEFENVVKVKKQTVAGTMHYITIRVTEGGAKKLYEAKVWEKPWENFKKLEEFKLVEDVPSA

SEQ ID NO: 9109 - protein, 526 aa, Burkholderia fungorum
MRKNLKNIGLIAAGLATGVFATLQLSASAQQPASAASSAVAPLPLDQLRLFAEVFGQIKHEYVEPVDDKKLLTAAIKGMVSSLDPHSSYLDKTDYEELQEQTKGRFAGLGIEISSEDGLIKVISPIEDTPAFRAGIRPGDLITRINDKPVRGMTLDQAVKQMRGDPGTKVTLTIFRKTDDRTFPLTVTRAIIKVQSVKMKILAPGYAYVRITSFQERTTPDLAAKLQDIARQQPNLKGLVLDLRNNGGGLLQSAVGVAGAFLPPNSVVVSTNGQIPDSKQVYRDTYDNYRLQSFDSDPLKDEAPIFKTVPMIVLTNAYSASASEIVAGALQDQHRALIVGKTTFGKGSVQTVRPMTADTALRLTTAYYYTPSGRSIQNKGIRPDIAVDQYAEGDPDDALVTREVDYSNHLANTQDPNEKKEAEQREQERMDQLRQLEEQNDKKTPEQRQKDRERKPVEFGSADDFMLQQALNKLEGKPVQESKSLTERRLAQNKPPASASAPVAVKPTQPVPGASAPASAPATPSN

SEQ ID NO: 9110 - protein, 401 aa, Cryptococcus neoformans
MSTSTRRHVPDDKLANHKADPNAAANAGQVQERTTKGSSSSAPRKVRFNVGNNYHVVDVIGEGAYGVVASAVHRPSGTKVAIKKIAPFDHSMFALRTLRELKLLKYFAEEGVSENIISVLDIIKPPSYDTFKEVYLVQELLETDLHRVIRTQDLSDDHCQYFLYQTCRALKALHSAEIIHRDLKPSNLLLNANCDLKVCDFGLARSTQTAFPAEGNNQGFMTEYVATRWYRAPEVMLSFRMYTKSIDVWSVGCILAEMLSGKPLFPGKDYHNQLALILDVLGTPTIDEFHAITSKRSKDYIRSLPFRKKRTFESIYPSANPLAIDFLRKTLTFDPRKRYTVEQCLAHPYLDAYHDPEDEPSAKPLPPSFFEFDMMKDDISREELKRLLYEEIMGFRPVLEG

SEQ ID NO: 9111 - protein, 463 aa, Thermobifida fusca
MSNDHLPEFPAGFWFGAATASYQIEGAVHADGRGPSIWDTYSHTPGLVLNGDTGDVACDHYHRYPEDVELLRRLGVDAYRFSIAWPRVMPTGSGDVNQRGLDFYDRLVDALLEAGITPVPTLYHWDLPQALEDAGGWRSRSTAEHFAAYTRAVVARLGDRIRHWITLNEPFCSAFLGYAVGRHAPGAREGTPALAAAHHLLLAHGLAVQELRAADAGEVGITLNPDRILPASDSAADRAAADRAETLHNRVWFDPLFAGRYPANEADVWGELADGSYRRDGDLEIIGQPLDFLGINYYRPLKVADGPLTEADPARRTAVDIRAHQQRFDGVRHTAMDWPVVPESFTDLLLDLTERYPNLPPIYITENGSAEHDVVSPDGRVHDTDRIAYLNDHLHALAAAIRAGVDVRGYFVWSLLDNFEWAFGYERRFGIVRVDYDTLERLPKDSYFWYQRLIEHHRARHRG

SEQ ID NO: 9112 - protein, 727 aa, Xanthomonas campestris
MTYNVSSCMKAGLLALVLTTPMALLARADTALPAAATPDQATATKLVYGLLSDSRYAYRPRTLDEAMSKDVFKRYLETLDGGKQFFTQADIDSFAPLQAGVGDALRGGNLEPAFQVFSVYKKRVDQRVKYARDLLKQDFDFSGNDKFEYDRKDVPWAADDKQLDVLWRQSVMNDWLRLKLAGKKPDDIRKTLDKRYVALADSVKQLKGEDVFQFFVNAYTNAVDPHTDYFTPRTAETFNQQMSLSLEGIGAQLQKQDDMVVIREVIPGGPAAVDGTLKPGDRIVGVGQSKNGAIEDVIGWRIDDVVAKIRGSKDTQVRLEYIPAESGIDGKHRTVTLTRQKVRLAEQAAKGETITLPATGSEPQRRIGIIKLPGFYQDFEGRRRNATDYASATRDVAKLLAGFKTDKVDGVVLDLRNNGGGSLDEAIELTGLFIEQGPVVQVRESGGRVTVNGDSDPKVAWDGPLAVLINRGSASASEIFAGAIQDYGRGLVIGETSFGKGTVQNIVDLDRWPAAEGQRYGQVKLTIAQFFRVSGSSTQHKGVVPDIAFPASVDASEFGESTYDNALPWTRIAAAPHTQYGNFAPLLPKLQALHTARIATDKEFQWWEEDVKQFRDEKAKKYISLNEAERVAERQKQDQQRKDRQQIRKQLGLPLDPLAEDSDDGLTGNERDIVKDTAREKAAEKRPDPLLHESAAILADALGLLSQDKPLSAQVLPKSTAPGRWAD

SEQ ID NO: 9113 - protein, 469 aa, Arabidopsis thaliana
MEESNRSSTVLFDKYNIGRLLGTGNFAKVYHGTEISTGDDVAIKVIKKDHVFKRRGMMEQIEREIAVMRLLRHPNVVELREVMATKKKIFFVMEYVNGGELFEMIDRDGKLPEDLARKYFQQLISAVDFCHSRGVFHRDIKPENLLLDGEGDLKVTDFGLSALMMPEGLGGRRGSSDDLLHTRCGTPAYVAPEVLRNKGYDGAMADIWSCGIVLYALLAGFLPFIDENVMTLYTKIFKAECEFPPWFSLESKELLSRLLVPDPEQRISMSEIKMIPWFRKNFTPSVAFSIDETIPSPPEPPTKKKKKDLNEKEDDGASPRSFNAFQFITSMSSGFDLSNLFEIKRKPKRMFTSKFPAKSVKERLETAAREMDMRVKHVKDCKMKLQRRTEGRKGRLSVTAEVFEVAPEVSVVEFCKTSGDTLEYYLFCEDDVRPALKDIVWSWQGDDDEDDVTTNDNVDTNDNKINNVS

SEQ ID NO: 9114 - protein, 540 aa, Streptococcus agalactiae
MAKDIKFSADARSAMVRGVDILADTVFVTLGPKGRNVVLEKAFGSPLITNDGVTIAKEIELEDHFENMGAKLVSEVASKTNDIAGDGTTTATVLPQAIVREGLKNVTAGANPIGIRRGIETAVSAAVEELKEIAQPVSGKEAIAQVAAVSSRSEKVGEYISEAMERVGNDGVITIEESRGMETELEVVEGMQFDRGYLSQYMVTDNEKMVSELENPYILITDKKISNIQEILPLLEEVLKTNRPLLIIADDVDGEALPTLVLNKIRGTFNVVAVKAPGFGDRRKAMLEDIAILTGGTVVTEDLGLDLKDATMQVLGQSAKVTVDKDSTVIVEGAGDSSAIANRVAIIKSQMEATTSDFDREKLQERLAKLAGGVAVIKVGAATETELKEMKLRIEDALNATRAAVEEGIVSGGGTALVNVIEKVAALKLNGDEETGRNIVLRALEEPVRQIAYNAGYKGSVIIARLKQSEIGTGFNAANGEWVDMVTTGIIDPVKVTRSALQNAASVASLILTTEAVVANKPEPEAPTAPAMDPSMMGGF

SEQ ID NO: 9115 - protein, 365 aa, Mangifera indica
QMGLAENQLCFDLIEDWIRKNPYASICTAEGVDEFKEIANFQDYHGLPEFRKAVAKFMGKVRGGRVTFDPDRIVMGGGVTGANEQIIFCLADPGDAFLVPSPYYPAFDRDLGWRTGGEIVPVPCDSSTNFQITRDALEEAYEKAREANINIKGLIITNPSNPLGITLDRDTLKSLVSFIDEKNIHFVCDEIYAATLFCPPKFVSVAEVIQEMDCNLDLIHIVYSLSKDMGLPGFRVGIVYSYNDAVVSCIRKMSSFGLVSSQTQYLLASMLSDDEFVEKFLAESSKRLAKRYHIFTKRLEKVGINCLKGNAGLFFWMDLRHLLQQETVDAEMKLWGTILNDVKLNVSPGSSFHCQEPGWFRVCFA

SEQ ID NO: 9116 - protein, 286 aa, Triticum aestivum
  misc_feature (219)..(219): Xaa can be any naturally occurring amino acid
  misc_feature (228)..(228): Xaa can be any naturally occurring amino acid
  misc_feature (241)..(241): Xaa can be any naturally occurring amino acid
  misc_feature (251)..(251): Xaa can be any naturally occurring amino acid
  misc_feature (283)..(283): Xaa can be any naturally occurring amino acid
PAGYRYMEDEAEKLMAESFSKNFIDYEEYPQSADIQNRCVNMIGDLFHAPPGSSVGTSTVGSSEAIMLGVLAMKRRWKNRRIAEGKSTEHPNIVMSSAVQVCWEKATRYFEIDEKLVYCTPDRFVMDPEQAVDLCDENTIGMCAILGTTYTGEYEDIKAINDLLVERNLDVPIHVDAASGGFVAPFVVPDLEWDFRCEKVVSINVSGHKYGLVYPGGGXVIWRSPEFXPQELVFNINYLGXDQSSFTLTFXKGASQVIGQYYQLIRLGKHGYRAIMSNLTRTXDYL

SEQ ID NO: 9117 - protein, 306 aa, Hevea brasiliensis
MPSHGDLDRQIEHLMECKPLPEARGQTLCDQARAILVEEWNVQPVKCPVTVCGDIHGQFYDLIELFRIGGNAPDTNYLFMGDYVDRGYYSVETVTLLVALKVRYRDRITILRGNHESRQITQVYGFYDECLRKYGNANVWKYFTDLFDYLPLTALIESQIFCLHGGLSPSLDTLDNIRALDRIQEVPHEGPMCDLLWSDPDDRCGWGISPRGAGYTFGQDIAAQFNHTNGLTLISRAHQLVMEGYNWCQEKNVVTVFSAPNYCYRCGIMAAILEIGENMAQNFLQFDPAPRQIEPDTTRKTPDYFL

SEQ ID NO: 9118 - protein, 372 aa, Debaryomyces hansenii
MSNTKANVATFEGHRNLRFRLILATLAGKAVKITKIRSDDMDPGLKDYEVSFLRLLESVTNGSQIEISYTGTTVIYKPGIIIGGQVTHNCPTNKPIGYYLEPMLYLAPFSKKKFSVVFKGLTASDKTKDAGIEAIKWGLLPLMEKFGVREVSLHILKRGSPPLGGGEVHFMCNSLIPQPMTIHALESPKISAIRGVAYCTRVSPSTVNRIIDSARNILRPTGVEVNITADAWRGDNSGKSPGFGVTLVAELKKGWRILAEGVGSPGTLPEDLGERAAYELLDELTKSCVIGRNQILLSLCYMTIGKEDIGRLKLHKDQIDDNFVWALRDIKNVFGTEAFLKDGAEEAVPGEEDYMTLSLKGIGFTSASKKIA

SEQ ID NO: 9119 - protein, 528 aa, Porphyra purpurea
MSKQILYQDDARKALEKGMDILTEAVSVTLGPKGRNVVLEKKFGAPQIVNDGVTIAKEISLEDHIENTGVALIRQAASKTNDVAGDGTTTATVLASAIVKQGMRNVAAGSNPMAIKKGIEKATNFVVSKIAEYAKPVEDTTAIVQVASISSGNDAEVGKMIADAIDRVGREGVISLEEGKSTSTSLEITEGMQFEKGFISPYFVTDLDRMEVLQENPFILFTDKKITLVQQELVPLLEQIAKTSKPLLIIAEDIEKEALATIVVNKLRGILNVVAVRAPGFGDRRKSLLEDMSILTGGQVITEDAGFSLDTVQLDMLGKARRVVVTKDSTTIIADGHEATVKSRCEQIKRQIETSDSLYEREKLQERLAKLSGGVAVIKVGAATETEMKDKKLRLEDAINATKAAIEEGIVPGGGSTNVHISGELFVWAKNNLFEDELIGALIVQRALTYPLRRIAFNAGDNGAVVVEKVKTNDFCIGYDASNGKIVNMYDAGIIDPAKVARSALQNATSIAAMVLTTECIVVDKLEA

SEQ ID NO: 9120 - protein, 476 aa, Lycopersicon esculentum
MDLETSEISNYKSSAVLSKLASNEQHGENSPYFDGWKAYDNDPFHLVNNLNGVIQMGLAENQLSVDLIEEWIKRNPKASICTNDGIESFRRIANFQDYHGLPEFTNAIAKFMEKTRGGKVKFDAKRVVMAGGATGANETLILCLADPGDAFLVPTPYYPGFNRDLRWRSGVQLLPISCKSCNNFKITIEAIEEAYEKGQQANVKIKGLILTNPCNPLGTILDRDTLKKISTFTNEHNIHLVCDEIYAATVFNPPKFVSIAEIINEDNCINKDLVHIVSSLSKDLGFPGFRVGIVYSFNDDVVNCARKMSSFGLVSTQTQHLLAFMLSDDEFVEEFLIESAKRLRERYEKFTRGLEEIGIKCLESNAGVYCWMDLRSLLKEATLDAEMSLWKLIINEVKLNVSPGSSFNCSEVGWFRVCFANIDDQTMEIALARIRMFMDAYNNVNKNGVMKNKHNGRGTTYDLTPQMGSTMKMLLA

SEQ ID NO: 9121 - protein, 199 aa, Oryza sativa
MAAVSLRKSNARLPPEVNRVLYVRNLPFNISSEEMYDIFGKYGAIRQIRLGNAKDTRGTAFVVYEDIYDAKNAVDHLSGFNVANRYLIVLYYQPAKMSKKSDVKKKEEEITRLQEKYGLGSKTPSSAPDAPLELICNYVLRIKLWLCTSNMCYLLFLLGQQNLCNKMALANTSYSIARHIIVLQVTKTKGLGKLKGTTT

SEQ ID NO: 9122 - protein, 469 aa, Bacillus licheniformis
MTEQTKKFPEGFLWGGAVAANQVEGAYNVGGKGLSTADVSPNGVMYPFDESMESLNLYHEGIDFYHRYKEDIALFAEMGFKAFRTSIAWTRIFPNGDETEPNEEGLEFYDRLFDELLKYNIEPVVTISHYEMPLGLIKKYGGWKNRKVIDCYEHYAKTVFTRYKEKVKYWMTFNEINMVLHAPFTGGGLVFEEGENKLNAMYQAAHHLFVASALAVKAGHDIIPDAKIGCMIAATTTYPMTPKPEDVLAAMENERRTLFFSDVQARGAYPGYMKRFFKENGITIEMAEGDEDILKENTVDYIGFSYYMSMVASTSPEDLAKTEGNLLGGVKNPYLESSEWGWQIDPKGIRITLNTLYDRYQKPLFIVENGLGAVDVVEEDGSIQDDYRINYLRDHLKEVREAIADGVDLIGYTSWGPIDLVSASTAEMKKRYGYIYVDRDNEGKGTLSRTRKKSFYWYKKVIETNGESL

SEQ ID NO: 9123 - protein, 429 aa, Prochlorococcus marinus
MNSSFNKFLIFKKWIIIIMICIFSTNFFYIPSADALSDSKQFVLDAWTLVNEGYYDPERLDELQWKRIRQKTLQKQIETSEEAYSAIEDMLKPLEDPFTRILKPKDYELLKTSNFGSEINGVGLQLGEDEITKEINVISTLAGSPAEEAGIISGDQIVKVDGISCSELGLANTASKLRGESGTKVLVQIKSISDETKEIDLERRSVDLRPVRTKRLRDDSHTIGYLRITQFSESVPKKIEEALQELKDKEVEGVILDLRNNSGGLVSSGIAVADSFLSEKPIVETKDRNGIKDAIISQKNTSFEGPMVTLVNKGTASASEILAGSLQDNNRSTLMGEQTYGKGLIQSLKSLGEDSGIAITVASYLTPQGNNIQGKGITPDKILGLPEAREYGNSEDKWVKNAEIFLNALFDENDVEDKVNELENKDIEN

SEQ ID NO: 9124 - protein, 392 aa, Unknown
  Annona sp. SM-1999
PYEVPMTAAGALQSYKLAAKAIARLQALPSGNLQKLIDTVVEEVFELTGYDRAMAYKFHDDDHGEVISEITKPGLEPYLGLHYPATDIPQAARFLFMKNKVRMICDCNAKPVKVYQDEKLKLELTLCGSTLRAPHSCHLKYMENMGSIASLVMAVVINESDNEDDNSMVEQQQQQQPKRKRLWGLVVCHNTTPKFVPFPLRYACEVLMQVFAIHVNKELELENQIREKHLRTQTLLCDMLMRDAPLGIVTQSPNIMDLVKCDGAALLYNNKFWRLGLTPSEAHMRHIVSWLNEYHMDSTGLSTDSLHDAGYPGALALGDAVCGMAAVRITSKDILFWFRTHTAAEIRWGGAKHDPSDKDDGRRMHPRSSFKAFLEVVKSSSFPWKDYEMDAI

SEQ ID NO: 9125 - protein, 341 aa, Unknown
  Annona sp. SM-1999
EPVNPADVPVTAGGALKSYKLAAKAISRLQSLPSGNIPLLCDVLVREVSELTGYDRVKAYKFHEDEHGEVIAECRRSDLEPYLGLHYPATDIPQASRFLFMKNKVRMISDCLSPPVKVIQGKGLAQPLSLCGSTLRAPHGCHAQYMANMGSISSLVMSVTIDEDNDDTCSEQQQKGRRLWGLVVCHHTSPRFVPFPLRYACEFLMQVFGIQLNKEVELAAQSREKHILQMQTMLCDMLLRDAPVGILSQSPNVMDLVNCNGAALYYQNQFWLLGTTPTEAQIRDIVGWLLEYHNSTTGLSTDSLVEAGYPGAAELGDDVCGMAAVRITSKDFLFWFRSHTA

SEQ ID NO: 9126 - protein, 365 aa, Escherichia coli
MSSEKLYSPLKVGAITAANRIFMAPLTRLRSIEPGDIPTPLMAEYYRQRASAGLIISEATQISAQAKGYAGAPGIHSQEQIAAWKKITAGVHAENGHMAVQLWHTGRISHASLQPGGQAPVAPSALSAGTRTSLRDENGQAIRVETSMPRALELGEIPGIVNDFRQAIANAREAGFDLVELHSAHGYLLHQFLSPSSNHRTDQYGGSVENRARLVLEVVDAGIEEWGADRIGIRISPIGTFQNTDNGPNEEADALYLIEQLGKRGIAYLHMSEPDWAGGEPYTDAFREKVRARFHGPIIGAGAYTVEKAETLIGKGLIDAVAFGRDWIANPDLVARLQRKAELNPQRAESFYGGGAEGYTDYPTL

SEQ ID NO: 9127 - protein, 390 aa, Unknown
  Aquilegia sp. SM-1999
PYEVPMTAAGALQSYKLAAKAIARLQSLPSGSIDRLCDTVVEEVFQLTGYDRVMAYKFHDDDHGEVVSETTKEGLPPYLGLHYPATDIPQAARFLFMKNKIRMICDCRAKHVRVLQDEKLPFELTLCGSTLRAPHSCHLQYMENMDSIASLVMAVVINDGDEEEGTVEGASQSRKRKRLWGLVVCHNTTPRFVPFPLRYACEFLIQVFAIHVNKEFELENQILEKNILRTQTLLCDMLMRNAPIGIVSQSPNIMDLVKCDGAALLYQNKIWRLGLSPSESHIRDIASWLSEYHMDSTGLSTDSLYDAGFPGALSIGDTVCGMAAVRINSKDMLFWFRSHTAGEIRWGGAKHDPGEKDDGRKMHPRSSFKAFLEVVKTRSFPWKDYEMDAI

SEQ ID NO: 9128 - protein, 392 aa, Unknown
  Aquilegia sp. SM-1999
DLEPVNPADVPVTAAGAMKSYKLAAKAISKLQSLPSGNIPFLCEVLVQEISDLTGYDRVMVYKFHEDDHGEVIAEWKISDLEPYLGLHYPATDIPQASRFLFMKNKVRMIWDCTAAPVKVIQDTNLPQPLSLGGSTLRAPHGCHAQYMANMGSVASLVMSVTINDDDDDEVVNGQQKGRKLWGLVVCHHTCPRFVPFPLRYACEFLIQVFSMQINKEVELARQLREKHILQTKTVLCDMLLRDAPIGIFTQSPNVMDLVKCNGAALYYHQKFWLLGVTPTEAQIRDIVEWLVEYHNASTGLSTDSLVEAGYPGASILGNAVCGMAAAKITSKDFLFWFRSHTANEIKWGGAKHDPTEKDDGWKMHPRSSFKAFLDVVKHRSVPWEDIEMDAI

SEQ ID NO: 9129 - protein, 293 aa, Brassica napus
VPPLQTLGISRRPTPSDAGESAKLIRQRYREAADLIKKGKMCCLFINDLDAGAGRMGGTTQYTVNNQMVNATLMNIADNPTNVQLPGMYNKEDNARVPIIVTGNDFSTLYAPLIRDGRMEKFYWAPTREDRIGVCKGIFRTDNVKDEDIVTLVDQFPGQSIDFFGALRARVYDDEVRKFVEGLGVEKIGKRLVNSREGPPVFEQPAMTLEKLMEYGNMLVMEQENVKRVQLADQYLNEAALGDANADAIGRGTFYGKAAQQVNIPVPEGCTDPQADNFDPTARSDDGTCVYNF

SEQ ID NO: 9130 - protein, 345 aa, Austrobaileya scandens
TGYDRVMAYRFHEDDHGEVVSEIRKSELEPYLGLHYPATDIPQAARFLFMKNKVRMICDCHAKSVTVHQDEKLQFDLTLCGSTLRAPHSCHLQYMANMGSIASLVMAVVVNEGEQDEEETAEPNQQPQLKRKRLWGLVVCHNTTPRFVPFPLRYACEFLIQVFAIHVNKEMELQNQLQEKNILRMQTLLCDMLLRDAPLGIVTQSPNIMDLVKCDGAAVLYGNKVWLLGVTPTESQIQDIASWLSESHMDSTGLSTDSLFEAGYPGALALGAKVCGMAAVKITLKDMLFWFRSHTAAEVRWGGAKHDPVDRDDGRRMHPRSSFKAFLEVVKSRSLPWKEYEMDGI

SEQ ID NO: 9131 - protein, 360 aa, Austrobaileya scandens
PFYAILHRIDAGLIIDLEPVNPADVPITAAGALKSYKLAAKAISRLQSLPSGNIGLLCDVLVQEVSELTGYDRVMAYKFHEDEHGEVIAEYRRSNLEPYIGLHYPATDIPQASRFLFMKNKVRMICDCFAPPIKVIQDKKLAQPLSLCGSTLRAPHGCHAQYMANMGSVASLVMSITVNDDDDETIGEQQNQQKGRKLWGLVVCHHTSSRFVPFPLRYACEFLIQVFGIQLNKEVELAAWMREKHILQMQTLLCDMLLRDAPVGIMTQSPNVMDLIKCDGAALYYGKQLWLLGTTPTEAQIRDIAGWLLEYHGGTTGLSTDSLMEAGYPAAAALGDGVCGMAAAKLTSKDFLFWFRSHTA

SEQ ID NO: 9132 - protein, 396 aa, Brasenia schreberi
PYEVPMTAAGALQSYKLAAKAIARLQSLPSGSVGRLIDTVVEEVHQLTGYDRVMTYKFHEDDHGEVVSEIRKPDLEPYLGLHYPATDIPQAARFLFMKNKVRMICDCRAKPVKVYQDENLKTDLTLCGSTLRAPHSCHLQYMDNMGSIASLVMAVVINEGEDEGDDEPEQNQGQQQQQQQKKKRLWGLVVCHNTTPRFVPFPLRYACEFLMQVFAIHVNKEVELENQMREKNILRTQTLLCDMLLRDAPLGIVTQSPNVMNLVKCDGAALLYGNKLWLLGQTPSESQMRDLAVWLSEYHRDSTGLSTDSLYEAGYPGALAIGDVVCGMAAVRITNSDMLFWFRSPTASEIRWGGAKHDPEEKDDGRRMHPRSSFKAFLEVVKTRSLPWKGFEMDAI

SEQ ID NO: 9133 - protein, 582 aa, Magnetospirillum magnetotacticum
MCGLAALFSYRADAPPPDAAELARMTGAMTRRGPDGEGVWSGAEGRVRLGHRRLSIIELGEPGAQPMIADDGKTAIVFNGEIYNYRALRLRLEQQGVRLRSHSDTEVILEGYRLLGPDILAQLRGMFALAIWDGERGGILAARDGLGIKPLYVADDGRTVRLASQVKALLAGGGIETAPDPAGHAGFFLWGHVPEPHTLYRSIRALKPGTWERWGLDGRRDSGAFFDLGAELRRPRQAPRADLKSALEDSVAHHLVADVPVGVFLSAGRDSTTLAAMAAKLGTGKVKSVTLAFEEFAGTPKDEAPLAELAARHYATEHITRRIPGGDFAACRDQILADMDQPTIDGVNVWFVARAARESGLKVALSGLGGDELFAGYDNFTTIPRIVSVLGPSGAIPGLGRGFRALAGHFVRPKLAGLLELGTTLPDAYLLRRGLFMPWELPQVMDADMARIGLEALAPRLHLKRAAAGLGDDVAAISALEMQFYMRNQLLRDADWAGMAHSLEIRVPLVDTHLLDAVLDLRAAGRTPGKADMAACADPGLPTAILERPKTGFFVPVAQWLGESSLRGWAKRVHAALCEETL

SEQ ID NO: 9134 - protein, 352 aa, Unknown
  Cabomba sp. SM-1999
DLEPVNPADMPSTAAGALKSYKLAAKAISRLQVLPSGNIGLLCDVLVREVSELTGYDRVMAYKFHEDEHGEVIAECKRPDLESYLGLHYPATDIPQASRFLFIKNKVRMICDCTAAPVKVIQNENLEPPLSLCGSTLRFPHGCHVQYMTNMGSIASLVMSVVINESDEATANDQPEAAATSEQPQKGRKLWGLVVCHHRKPRFIPYPLRYACEFLIQVFSVRLNKEVELAIQVREKHILRTQTVLCDMLLRDAPVGIVTQSPNIMDLVKCNGAALYYGKQFWLLGTTPTEAQIRDIIAWLHESHGSSTGLSTDSLMEAGYPRALVLGNAVCGMAAVKITSRDFLFWFRSHTA

SEQ ID NO: 9135 - protein, 390 aa, Calycanthus floridus
PYEVPMTAAGALQSYKLAAKAITRLQSLPSGSMERVVDTVVQEVFELTGYDRVMAYKFHEDDHGEVISEITKPGLEPYLGLHYPATDIPQAARFLFMKNKVRMICDCHAKPVKVCQDEKLTFDLTLCGSTLRAPHSCHLQYMENMGSIASLVMAVVINEGEEDDEVGISQQQQQRRKRLWGLVVCHNTTPRFVPFPLRYACEFLMQVFAIHVSKEIELENQLREKNILRTQTLLCDMLLRDALLGIVTQSPNIMDLVKCDGASLLYGNKMWRLGLTPTESQIHDIAMWVSEYHMDSTGLSTDSLYDAGYPKALSIGDVVCGMAAVRITAKDMLFWFRSHAAAEVRWGGAKHDPSDKDDGRRMHPRSSFKAFLEVVKTRSSPWKDYEMDAI

SEQ ID NO: 9136 - protein, 393 aa, Calycanthus floridus
DLEPVNPDDVPVTAAGALKSYKLAAKAISKLQSLPSGNISLLCDVLVREVSELTGYDRVMAYKFHEDDHGEVIAECRRSDLEPYLGLHYPATDIPQASRFLFMKNKVRMICDCLAPPVKVIQDKRLAQPLSLCGSTLRAPHGCHAQYMANMNSIASLVMSVMVHENDDRQEMSSSRKGRKELWGLVVCHHTTPRLSFPLRYACEFLIQVFGIQLNKEIELAAQMREKHILRTQTVLCDMLQRDAPVGIIRQTPNVMDLVKCDGAALYYRNQFWLLGTTPTDAQIRDIAEWLLEYHSSSTGLSTDSLMEAGYPGASVLGDAVCGMAAIRITSKDFLFWFRSHTAKEIKWGGAKHDPVDQDDDDRKMHPRSSFKAFLEVVKCRSLPWEDIEMDAI

SEQ ID NO: 9137 - protein, 568 aa, Secale cereale [sequence omitted]

SEQ ID NO: 9138 - protein, 389 aa, Streptomyces avermitilis
MSGPDPFCEPRRFGRGAALTLLFASVLVAGAATGSFDEPDDSGRKASSARPAPASHREDVAEAAAEAAADGKSPVEAAERAVSRSGDRWGAVYSQGEYEEFEEALDGQYTGVGLWARRERDGRIEVSRVQSGSPAAAAGIREGDRLRTVDGENVAGKPVTDVVSLLRGDAGDAAAGTRVRLGLARGTHAWDETVRRARLSTDPVTVRRLADDVTVIKVAAFTKGSGDRVRAAVADAPHADGIVLDLRGNSGGLVTEAVTAASAFLDGGLVATYDVNGEQCALHADSGADTTRPLVALVDGGTMSAAELLTGALQDRGRAVVVGTRTFGKGSVQMPSRLPGGSVAELTVGHYRTPSGHSVDGRGITPDLEADTEALERAGTVLSGLGDPS

SEQ ID NO: 9139 - protein, 547 aa, Rickettsia rickettsii
MATKLIKHGSKAREQMLEGIDILADAVKVTLGPKGRNVLIEQSFGSPKITKDGVTVAKSIELKDKIRNAGAQLLKSAATKAAEVAGDGTTTATVLARALAREGNKLVAAGYNPMDLKRGMDLAVNAVVEEIKKSSKKINSQEEIAQVGTISSNGDKEIGEKIAKAMEEVGKEGVITVEEAKNFSFDVEVVKGMMFDRGYLSPYFVTNSEKMVAELENPFILLFEKKLSNLQPMLPILEAVVQSQRPLLIIAEDVEGEALATLVVNRLRGGLKVAAVKAPGFGDRRKAMMEDIAILTKGELITEDLGMKLENVSIKSLGTAKRVTISKENTVIVDGNGDKKNIEDRVLQIKSQIAETTSDYDKEKLQERLAKLSGGVAVLKVGGATEVEVKERKDRVEDALAATRAAVEEGVVAGGGVTLLHASQPLTKLKVENKDQQAGIEIVIEALKDPLKQIVENAGENGGVVVGKLLEHKDKNYGFNAQDMQYVDMIKAGIIDPAKVVRTALQDAASVASLIITTETLIVDEPSDKAEPMPMRGGMGGMGGMDF

SEQ ID NO: 9140 - protein, 502 aa, Oryza sativa
MMDGRSILMGRYEVGKQLGQGTFAKVYYARNLTTGQAVAIKMINKDKVMKVGLMEQIKREISIMRLVKHPNVLQLFEVIASKSKIYFVLEYAKGGELFNKIAKEGKLSEDSARRYFHQLINAVDYCHSRGVYHRDLKPENLLLDENENLKVSDFGLSALAESKRQDGLLHTTCGTPAYVAPEVLSRKGYDGAKADVWSCGVILFVLVAGYLPFHDPNLIEMYRKICRADFRCPRYFSAELKDLIHKILDSDPSTRISIPRIKRSTWYRKPVEINAKNSEAATTNSISSGVATTSGSAECSTSEENQGSLSLPNLNAFDIISLSTGFNLSGFFEDTHGHQEERFTTRQPVTTVLGKLKELAKRLKLKVKKKDNGVLRLAAPKEGKKGFLELDAEIFEVTPSFLLVELKKTNGDTMEYRKLVKEDIRPALKDIVWVWQGDEHLNSQSILQGEQQQSPLPPELPQDQLQPSLPQQEKQDMPEPPLLPQVPQEEVQTSIPAEQTKN

SEQ ID NO: 9141 - protein, 160 aa, Glycine max
  misc_feature (128)..(128): Xaa can be any naturally occurring amino acid
  misc_feature (145)..(145): Xaa can be any naturally occurring amino acid
NSARGIIETPIDIYIVMEYAKSGELFDYIVEKGRLQEDEARNIFQQIISGVEYCHSNMVVHRDLRPEKVLLDSKCNVKIAGFGWSNIIRDGHFLKTRCGSSNYAAPEVISGKLYVGPKVDVWSCGVIXYFLLCGSFPFDDENIPXLFNKIKGGIFTLSFH

SEQ ID NO: 9142 - protein, 411 aa, Nostoc punctiforme
MNKQVFRVGFSLLMAFWLAFGTLTQPAVALTGEQKLVSEVWRIVNRTYLDETFNHQNWAAVRQKVLEKPLTDSNASYAAIGKMLKSLDDPFTRFLDPEQYRSLKVNTSGELTGVGLQIVLNPETGKLEVVAPIAGSPADKAGIRPRDRILKIEGVSTKNLTLDEAATKMRGPSGSLVTLLIERDGEPETEIKLTRDRIALNPVVSELRVSAEGTSIGYLRLTQFNANASMELAHAISSLEKKGAAAYILDLRNNPGGLLQSGIEIARQWLDSGTIVYTVNRQGIQGSFEALGPALTNDPLVILVNQGTASASEILAGALQDNGRAQLVGETTFGKGLIQSLFELSDGSGLAVTIAKYETPQHRDINKLGIKPDKVISQDPINREQIGTEADLQYQAAVELLKKDLVVAGKA

SEQ ID NO: 9143 - protein, 406 aa, Unknown
  Azoarcus sp. EbN1
MVRKSAKLANVCYDIRGPVLIKAKQMEDEGHKIIKLNIGNLAAFGFDAPEEIQLDMIRNLPNSAGYSESKGIFAARKAVMHYTQQKHIKGVTLEDIYIGNGVSELIVMAMNALLNIGDEVLVPAPDYPLWTAAVSLSGGTPVHYICDEANEWLPDLDDMRARITPNTRAIVVINPNNPTGALYPDHILQGIVDIAREHGLIVYADEVYDKVLYDGATHRSMGSFSEDVLTILFNGLSKNYRSCGYRAGWMVVCGDKRHAQDYIEGLNMLASMRLCANVPGQYAIQTALGGYQSIDDLVAEGGRMRRQRDLAHELISAIPGVSCVKPKATLYMFPKLDPKLYPIEDDQAFIAELLEEERVLLVQGSGFNWPHPDHFRLVFLPHEDDLRDAIGRIARFLEQYRKRHAA

SEQ ID NO: 9144 - protein, 349 aa, Canella winterana
DFEPVKPYEAPMTAAGALQSYKLAAKAIARLQSLPSGSMKRLVDTVVQEVFDLTGYDRVMAYKFHEDDHGEVISEITKPDLEPYLGLHYPSTDIPQAARFLFMKNKVRMICDCHALPVKVYQDDKLTFDLTLCGSTLRAAHSCHSQYMANMGSIASLVMAVVVNEREEEDENSESSEQQQQQKKKRLWGLVVCHNTTPRFVPFPLRYACEFLMQVFAIHVNKELELENQIQEKNILRTQTLLCDMLMRSAPLAIVTQNPNIMDLVKCDGASLLYQSKIWRLGVAPTESQIRDIARWLSDCHMDSTGLSTDSLHDAGYPGALLLGDVVCGMAAVKINSKDMPFWFRSHTA

SEQ ID NO: 9145 - protein, 393 aa, Canella winterana
DLEPVNPTDVPVTAAGALKSYKLAAKSISRLQSLPSGNIQLLCDVLVREVSDLTGYDRVMAYKFHEDEHGEVIAECRRSDLEPYLGLHYPATDIPQASRFLFMKNKVRMICDCSAPPVKVIQDKRLAQSLSLCGSTLRAPHGCHAQYMANMGSIASLVVSVTVSEDDDETESEQQQKGRKLWGLVICHHTCPRFVPFPLRYACEFLIQVFGIQLNKEVDLASQIREKHMLRTQTMLCDMLLRDAPVGIVTQSPNVMDLVKCDGAALYYKNQFWLLGTTPTEAQIRDITNWLVEYHNSTTGLSTDSLAVAGYPGASVLGDAVCGMAAVKFTNKDLLFWFRSHTAKEIMWGGAKHDPVDKDDDGRKLHPRSSFKAFLEVVKRRSLPWEDVEMDAI

SEQ ID NO: 9146 - protein, 298 aa, Thermotoga maritima
MGSDKIHHHHHHMQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 9147 - protein, 391 aa, Chloranthus spicatus
PYEVPMTAAGALQSYKLAAKAIARLQSLPGGSMEKLCDTVVQEVFELTGYDRAMAYKFHEDDHGEVISETTKPGLEPYLGLHYPATDIPQAARFLFMKNKVRMICDCHAKPVKVFKMKKLAFDLTLCGSTLRAPHSCHSQYMVNMNSIASLVMAVVVNEGEEGDSSEPGQQQLQQKKKRLWGLVICHNTTPRFVPFPLRYACEFLMQVFAIHVNKELELENQIQEKNIFRTQTLLCDMLMRDAPLGIVSQNPNIMDLVKCDGAALLYNKKIWRLGLTPSESQIHDISFWLSENHMDSTGFSTDSLNDAGYPGAVAIGNAVCGMAAVWITSKDMLFWFRSHTAAEVRWGGAKHDPEDKDDNRRMHPRSSFMAFLEVVKTRSLPWKDAEMDAI

SEQ ID NO: 9148 - protein, 397 aa, Chloranthus spicatus
DLEPVNPADVPVTAAGALKSYKLAAKAISRLQSLPSGNISLLCDVLVREVSELMGYDRVMAYKFHEDEHGEVIAECRRVDLEPYLGLHYPATDIPQASRFLFMKNKVRMICDCSAAPVKVIQDKRLGQPLSLCGSTLRAPHGCHALYMANMGSIASLVMSVTINEDDDETKSDPQQQQQENRRKLWGLVVCHHTSTRFAPFPLRYACEFLLQVFSLQLNKEVELAAQLREKNMLRMQTLLCDMLLRDTPTGILTQSPNVMDLVKCDGAALYYRNQFWLFGTTPTDVQIRDMAEWLLECHDGSTGLSTDSLMEAGYPCASILGNAVCGMAAVKITSKDFLFWFRSHTAKEVKWGGAKHDPIDKDGDGRKMHPRSSFKAFLEVMKQRSLPWEDMEMDAI

SEQ ID NO: 9149 - protein, 379 aa, Gibberella zeae
MSTESKLWQPLKLGNVNLSHRIALAPMTRLRNDDDHLPLDSVIQYYSDRAGIPGTLVISEATGISKTAEAAPSTPGISSRDQVQRWKKVFDAVHEKGSYMFMQIWDLGRAGDPNYLKSRGYKYSSSSDIPMEGYPVAPEALTEKEIWEKIDEFRKAARNVIDAGGDGVEVHACHGYLIDQFISESVNNRTDKWGGSVENRARFLLEVVKAVTEEVGAQRTAIRLSPFATFQAAYTANPWDQFGYIIAELKEAQYKLAYISFVEPRGNPAQTDMTIHTLPGDNVNPWGDKKPSLDHFLEMWDNQSPVIVGGGYLPENVSAAVDGSYKGWDVVVAFGRWFTSNPDLVYRVKNGIPLTPYKREYFYAAKMRDLLKPPRPNGR

SEQ ID NO: 9150 - protein, 414 aa, Degeneria vitiensis
SGKPFYAIIHRVTGSLIIDFEPVKPYEVPMTAAGALQSYKLAAKAIAKLQALPSGSMEKLVDTIVQEVFELTGYDRAMAYKFHEDDHGEVISEVTKPGLEPYLGLHYPATDIPQAARFLFMKNKVRMICDCHAKPVEVYQDEKLTFDLTLCGSTLRAPHSCHLQYMENMDSIASLVMAVVINEGEDESGGPEQQQQQLKRKRLWGLVVCHNMTPRFVPCPLRYACEFLMQVFAIHVNKEFELENQIREKNILRTQTMPCDMLLRDAPLGIVTQSPNIMDLVKCDGAALLYNNKIWRLGFTPTESQIHDISIWLSEYHTDSTGLSTDSLRDAGYPDALALGDVVCGMAAVRISPKDMLFWFRSPTAAEVRWGGAKHDPCDKDDGRRMHPRSSFKAFLEVVKTRSLPWKDYEMDGI

SEQ ID NO: 9151 - protein, 393 aa, Degeneria vitiensis
DLEPVNPADVPVTAAGALKSYKLAAKAISRLQSLPSGNISLLCDVLVREVSELTGYDRVMAYKFHEDEHGEVIAESRRSDLEPYLGLHYPATDIPQASRFLFMKNKVRMICDCSAPPVKVIQDKRLAQPLSLCGSTLRAPHGCHTQYMANMGSISSLVMSVTINEDDDDMLSEQQQKGRKLWGLVVCHHTSPRFIPFPLRYACEFLIQVFGIQLNKEVELAAQMREKHILRMQTVLCDMLLRDTPVGIITQSPNVMDLVNCDGAALYYRNQFWLLGTTPTEAQIRDIAGWLVEYHDGTTGLSTDSLTEAGYPSAADLGDDVCGMATVKITSKDFLFWFRSHTGKEIKWGGAKHDPVDKDDDGRKMHPRSSFKAFLEVVKQRSLPWEDVEMDAI

SEQ ID NO: 9152 - protein, 388 aa, Drimys winteri
PMTAAGALQSYKLAAKAIARLQSLPGGSLKRLIDTVVLEVFELTGYDRVMAYKFHEDDHGEVISEVTKPDLEPYLGLHYPATDIPQAARFLFMKNKVRMICDCNAKPVKVYQDEKLTFDLTLCGSTLRAPHSCHLQYMENMGSIASLVMAVVINEREEQDENSGSEQQREQPRRKRLWGLVVCHNTTPKFVPFPLRYACEFLAQVFAIHVNKELELENQIQENNILRTQTLLCDMLMRAALLGIVTQSPSILDLVKCDGASLLYQNKIWRLGVAPTESQILDIALWLSEYHMDSTGLSTDSLQDAGHPGALSLGDVVCGMAAVRINSKDTLFWFRSHTAAEIRWGGAKHDPNQKDDGRKMHPRSSFKAFLEVVKTRSSPWADYEMDAI

SEQ ID NO: 9153 - protein, 568 aa, Candida albicans
MVLSKHIDALRLESQILKKTPQAQLRKEAFIDAYDSHKNIPQFEIPQNSSNEQLIYKYLSQELALDGIPTLNLASFVNTYVDDTSARLIQDNLTKNLADNDEYPSLIDIQTRCISILSNLWHAPGKVDKVTGNRVTNSIGTATTGSSEAIMLAGLALKKRWQLKRKAEGKSTDNPNILMATCAQVALEKFACYFDVENRLIPVTEESGHLIDVSKIKENIDENTIGIFVIMGSTFTGAFEPVEEISKLLDEVEKERGLDIRIHVDGASGGFVAPFIFPHLKWDFAVPRVDSINTSGHKFGLTSVGLGWVIWKDADLLPKELRFSLDYLGGVEETFGLNFSRPGFPVITQYYNFLSLGRQGYAKIFDGCMTNARLLSRFLEESKYFDVVSVIHHKLSDSEKKAQFTREVDDKKLDSKLYTINEEFKPGLPVVAFRFSKEVRDKYPELPQELLSTLLRKRGYIIPNYHLPPSENDKEILRVVVRNSLSLNLLERLIQDITGATELLIKAADSIADYVSTSGEHTDVENRERIHKLLAAIASGGVAEVKEEKHKKDNHQGSKNKKSYRGTC

SEQ ID NO: 9154 - protein, 398 aa, Candida glabrata
MPRTITFNIPKEYKLVDLVGEGSYGIVCSATHLPTGNKVAIKRIRFPDSPPSDDGQGVPRLEEDDEHDNIAKVALIRTIREIKILSHFNNHENIITIFEKIKPMQSINFKEIYLVQELMETDLSRILASSNTLTVDHIQYFLYQILRALKAIHSAKVIHRDLKPSNILLNSNCDLKICDFGLARTYDPDDDASTMNGNNVGFLTEYVATRWYRAPEIMLNFQDYSTAIDIWSCGCVLAEMLFRKPIFPGKDYHHQLLLILDTLGTPSPEDIEAINYGRAKEYILSLPHFPKKDWSQLLGTDNEMLLDILDKLMIFNPKRRITAEQALEHPFLATYHDPKDEPNFPPLNFKGDEFWQLDNCMETSNGYGTDDSNNLRANVTRRKLREILYQEMVTPAPR

SEQ ID NO: 9155 - protein, 394 aa, Drimys winteri
DLEPVNPVDVPVTAAGALKSYKLAAKAISKLQYLPSGNISLLCDVLVREVSELTGYDRVMAYKFHGDEHGEVIAECRRSDIEPYLGLHYPATDIPQASRFLFMKNKVRMICDCTARPVKVIQDKKLAQPLSLCGSALRAPHGCHAQYMANMGSIASLVMSVTISEDDDEASTEEQRQKGRKLWGLVVCHHVTPRFVPFPLRYACEFLIQVFGIQLNKEVELEAQLREKNMLRTQTMLCDMLLRDAPVGIVTQSPNVMDLVKCDGAALYYRNQFWLLGITPTEAQIRDIAEWLLEYHNSTTGLSTDSLMEAAYPGASILGDAVCGMAAVKITCKDFLFWFRSHTAKEIKWGGAKHDPGDKDGDGRKMHPRSSFKAFLDVVKQRSLPWEDVEMDAI

SEQ ID NO: 9156 - protein, 392 aa, Eupomatia laurina
PYEVPMTAAGALQSYKLAAKAIARLQALPSGSLEKLIDTVVQEVFELTGYDRAMAYKFHDDDHGEVISEITKPGLEPYLGLHYPATDIPQAARFLFMKNKVRMICDCYAKPVNVYQDEKLAFDLTLCGSTLRAPHSCHLQYMENMGSIASLVMAVVINDGEDEDESTGSGLQPPLLKKKRLWGLVVCHNTTPRFVPFPLRYACEFLMQVFAIHVNKELELENQICEKNILRTQTLLCDMLLRDAPLGIVTQNPNIMDLVKCDGVALLYDNKFWRLGLTPTESQMRDISAWLSEYHMDSTGLSTDSLYDAGYPGALALGDVVCGMAAVRITSKDMLFWFRSHTAAEVRWGGAKHDPNDKDDGRRMHPRSSFKAFLEAVKTRSLPWKDYEMDAI

SEQ ID NO: 9157 - protein, 247 aa, Gnetum gnemon
MGRGKIEIKRIENTTNRQVTFCKRRNGLLKKAYELSVLCDAEVALIVFSSRGRLYEFANNSVKRTIERYRKTCADNNQGGAIAESNAQYWQQEAVKLKQQIDVLNNQIRHYMGECLQSMTIKELKQLEGKLEKGLGRVRSKRNEKLLEDIDTLQRREDNLIRENEYIRNKIAECQSHQHANMLTAAAVEYDAIPAAYDSRNFMHANLIEAAAAHHHYAQQEQTALHLGSEHKYSVHYPDPQAHKFQT

SEQ ID NO: 9158 - protein, 393 aa, Eupomatia laurina
DLEPVNPADVPVTAAGALKSYKLAAKAISRLQSLPSGNISLLCDVLVRELSELTGYDRVMAYKFHEDEHGEVIAECRRLDLEPYLGLHYPATDIPQASRFLFMKNKVRMICDCSAPPVKVIQDKRLEQPLSLCGSTLRAPHGCHAQYMANMGTIASLVISVTINEDDDETPGEQQQKGRKLWGLVVCHHMSPRFVPFPLRYACEFLIQVFGIQLNKEVELAAQTREKHILRMQTMLCDMLLRDTPIGIVTQSPNVMDLVKCDGAALYYQNQFWLLRTTPTETQIRDIIGWLLEYHGDTTGLSTDSLTEAGYPGAADLGDDVCGMAAVKISSKDFLFWFRSHTAKEIMWGGAKHGPVDKDDDGRKMHPRSSFKAFLEVVKRQSLPWEDMEMDAI

SEQ ID NO: 9159 - protein, 883 aa, Oryza sativa
MSSAANVMLAIHEKRTTPTDLYRPLRLYIASAYSEREAAAADDDLAAVRDLRADVEQPSLPDPSSLERRRDALLAYARALSLVEPRFPISSDRAHVHSLAFTWHDAFKTGKKASVASIHLEKAAVLFNLAAVYSQIALAADRATDVGIRTACGSFQSAAGAFAWMRESGVAAKAVAAGATTVDVTPECAAMLEKLMLAQAQECFFEKVIAGGKPPALCSKVARQVGIFYEEAYAALSAAPLSQHFDKTWVSHVQLKAAQFYADACYRCSLDLHEKEEIAQEIARLKIGISALADAKKVARGVAAPLLDSVNKLESNMKTNLERAMKENDRVYLMRVPDASSLGALPAASLVKPTSLAEVLDASKERLFSSLVPDGSMKALSKYTEMVDNIIRTQAEKLQQASEITRVRLKEMDLPDSILSLEGNITLPLDLKEDVEAVQISGGPAGLEAELQQLRDLSRVNQELLVQTEEMLQKEANEDAQFRTQFGSRWTRPQSSTLTKNIQDRLNLFASNLKTAGDSDSQIERGLKESYPLISILDRRPIESALPSISRPIMSLDGNEDAIVGALKQSLRQLESLGAQRAGLEDMLKEMKRKDDILPKLMAGVGSHDDLFKKEISKYDPVCAEIADNIVAQEQLLLQIQAQNEQFAAVFNLEDYKVARERCYKQIAAAVAKYRDIKKNINEGLNFYVTLQEAIGKIKQQCSDFIMTRNIQCREMIEDVQKKLAGFSFSSSSSQASMQRNTSVPPDQNSPSPPPPSSHAPHAQGPYGVPPGGDSRPGYSQPEQRPAYSQPYPPYGAPPQQPPYGAPSQQPPYGAPHPGHYQQPPHQQPPNHDYGQQAYPGGWRGQYYNPHQPQPQPQPPYPQPPYNAQGSYPPHQSSYYRPQ

SEQ ID NO: 9160 - protein, 109 aa, Arabidopsis thaliana
  misc_feature (85)..(85): Xaa can be any naturally occurring amino acid
  misc_feature (102)..(102): Xaa can be any naturally occurring amino acid
MASSMLSSTAVVTSPAQATMVAPFTGLKSSASFPVTRKANNDITSITSNGGRVSCMKVWPPIGKKKFETLSYLPDLSDVELAKEXFDYLLRNKWIPCVEFEXEHGFFVP

SEQ ID NO: 9161 - protein, 488 aa, Saccharomyces cerevisiae
DVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAE

SEQ ID NO: 9162 - protein, 557 aa, Nostoc punctiforme
MANLTDFKLFAPRNKGAALIGSFSDWKEIPMSKSEDGYFRTKIKLEDGVYQYKFRIQTKSPNFAPDEWIDVIDPKATEVNETEKYGIVRIQDGQRIVDSYFWQHDEMPLPDNRELVIYEMHVADFTGDEVDSNERGKYLGIIAKLDYLCELGINAIELMPVNEYPGDYSWGYKVRHFFATESSYGSTEDLKRLIDECHGRGIRVFMDGIYNHTDEECPLILIDRNYWYYEHKHYPEDPANYWGPEFNYDFYDKNLNIQPAWEYIGDVVRFWIQEYHIDGIRFDAVRQLANFEFLNWLTKQAKNHAAPKQFYNIAEHIPDTNTVVKPDGPLDACWHESFRYFLVPYICGKSFELEQLKQILDPKQQGYAIATNVINYLATHDRERLLRELGNCGIFDAAAFERAKLAAVLLMTAMGIPMLWMAEEFGEYQQKSEDVTKPQKITWSLLLDDQNYDLFEYYQKLITLRQQTPALQSDNIKFFYENADDKVLAYSRWDEQNSHVVVVVNFSDRSLNQYKISDFPTTEDWRDWVGNREVKSGEDGLVTDLPSYTAKIFVLQT

SEQ ID NO: 9163 - protein, 555 aa, Thermobifida fusca
MLGRGGRLPPGKCRVGPAHWPSRLSSAEVSPTTRALSRHTGTSGPAPSRSLPAISTIKETDLTETNEALSTASNATGSTLDSGAPAASDRNSLSVGSNGPLLLHDVRLVETLAHFNRERVPERNPHAKGAGAFGVFETTEDVSQYTKAALFQKGARTEMLARFSTVAGEQGSPDTWRDVRGFALKFYTSEGNYDLVGNNTPIFFVRDPMKFPHFIRSQKRMPDTGLRDNNMQWDFWTLNPETAHQVTYLMGDRGLPRTWRHMNGYGSHTYMWINAKGEKFWVKYHFKTDQGIENMTNEEAERLAGVDADFHRRDLVEAIERGDYPSWTLYVQVMPYEDAKTYRFNPFDLTKVWPHSDYPLIKVGKMTLNRNPENFFAEIEQAAFAPSNLVPGIGVSPDKMLLGRVFAYADAHRARIGTNYFQLPVNKPRVKVNSYTFDGHMTYEHSGKAPVYAPNSYGRPWSDQTGPVEDSWEADGELVRSAYELHAEDDDFSQAGTLVREVFDDAQRDRLVETVADHLSKGVVEPVLSRAFQYWKNIDETIGERIEKRYHEIAR

SEQ ID NO: 9164 - protein, 622 aa, Prochlorococcus marinus
MCGITGIISFQSSIDPQNIHNMNETLMHRGPDHRDIWINEYSTVFLGHTRLSILDLSDNGNQPFHSKDGRFHLTFNGEIYNYKNLKDYLKTNGISNFKSNSDTEVLIELIALRGITNASKMLNGMFAFAVWDSLEKKIHLVRDRFGEKPLFYTLQKDTLYFGSEIKSILKIPTISKIINKEALSHYLRFNYIKNPLTIYKDIYKLEPGHILSIDQNITYKKYSYKNKNKKTIKLANQKEAEDLLQNQIIKSCLSRTISDVPIACFLSGGIDSSLVTSIIQRNSKQRIKTFTIGFDDQSIDESNYAEKIANFLGTDHTTINIEEKELLNNIDLQSEIYGEPFADQSSIATNILCKYASRDVKVCLSGDGGDEMFIGYDRYYKVNQLRLFLKAIKFYKKFKTIDRILEVLIHKIESNKNFSIKIDKIIKLISLLSDANDDNIYEKFNSLYRDQYFPLTPQNNQKHYIYKDLKNIQEMCEYDFETYLPDCILTKVDRASMHNSLEVRAPFLDHEIPEIIDSINPTYKKKLLNRKFILKKLLNKYLPKNIYERPKKGFSAPLNNWIKGPLKELTLDYLSIESLKKHNLLDIDIIERIKYEHYSGIRSWHNQIWNLLIFQQWYNKNF

SEQ ID NO: 9165 - protein, 538 aa, Chromobacterium violaceum
MAAKEVRFHDNARERIVNGVNVLADAVKVTLGPKGRNVLLARSFGAPHITKDGVSVAKEIELKDPFENMGAQMVKEVASKTADVAGDGTTTATVLAQAIVQEGMKYVASGMNPMDLKRGIDKAVHAVIKELQTLSKPVTNSKETAQVAALSANSDEAIGKIIADAMDKVGKEGVITVEDGKSLDNELAVVEGMQFDRGYLSPYFITDPEKQTAVLEDPLVLLYDKKISNIRDLLPVLEQVAKAGKPLLIVAEDVEGEALATLVVNSMRGILKVAAVKAPGFGDRRKAMLEDIAILTGGTVIAEETGLTLEKAGLAELGSAKRVEIGKENTTIIDGAGDKAKIDARVQAIRAQIDAATSDYDREKLQERVAKLSGGVAVIRIGAATEVEMKEKKDRVDDALHATRAAVEEGIVAGGGVALLRARAHIKELKGDNPDQDAGIQIVLRALEAPLRAIAANAGDEPSVIVNKVLEGKGNHGYNAASGQFGDLVEMGVIDPTKVTRTALQNAASIASLILTTDATVAEAGQDSKAKAPAELDY

SEQ ID NO: 9166 - protein, 254 aa, Legionella pneumophila
MTILPISAFSDNYIWTFIDKIAGVLDCVDPGEAGPIIRFAQSNQLTLRTILLTHHHYDHIGGVDLLIKQWPSCKVYGPIDERINNVTHPIKQGQSVQVGSLHFHILFNPGHTSTHISYYEPQQGWLFCGDTLFSAGCGRVFDGTIEELHESLLLFKKLPRNTKVFCAHEYTLQNLKFAHTVEPCNSSVINYMQQILKQPSPCTLPSNIDLELSINPFLRTDKEQVKQYALSHGANSSDSLDVFKVLRNQKNSFK

SEQ ID NO: 9167 - protein, 564 aa, Yarrowia lipolytica
MCGIFAAYKLPDVAEYKTHALQLSKRIRHRGPDWSGNCSKNNTIICHERLAIVGLDTGAQPITSPDESIVLGVNGEIYNHRILRKEFPDYKFKTHSDCEPIIPLYEKYGIDAPKKLDGMFAFVLYDSNKDRIIAARDPIGITTLYMGRSYKNPQTVWFASELKCLVDDCDEIKAFPPGHVYDSDTDKITRYFEPSWWDGSKIPTKRVDYKELREALEAAVRKRLMSEVPYGVLLSGGLDSSLIASIAARETRRAAPEKTVNQDLAGVDEQGHLTNSSGSRLHSFSVGLPGAPDLLAAQKCAEFIGTIHHEYTFTVQEGLDALRDVIYHLETFDVTTIRASTPMYLLSRKIKAGGVKMVLSGEGSDEVFGGYLYFGAAPSPEAFHTECVQRVKNLHYADCLRANKSTMAWGLEARVPFLDKQFLEVAMNIDPKDKIIDKDHIEKYSIRKAFDTSDEPGAEPYLPDEILWRQKEQFSDGVGYSWIDGLKDAAENTITDEQLKNPKPHWGADVPKTKEAYWYRCMFDELFPQPAAATTVMRWIPKADWGCAEDPSGRYVKSHSAHKQ

SEQ ID NO: 9168 - protein, 148 aa, Brassica napus
MDPYRVRPSSAHDSPFFTTNSGAPVWNNNSSLTAGTRGPILLEDYHLLEKLANFDRERIPERVVHARGASAKGFFEVTHDITHLTCADFLRGPGVQTPVIVRFSTVIHERGSPETLRDPRGFAVKFYTREGNFDLVGNNFPVFFVRDG

SEQ ID NO: 9169 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFFKVGKKTECFFRFFTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEVRKYDPDSNQRDLFNAIARGDFPKWKLSIQVMPEEDAKKYRFHPFDVTKIWYLQDYPLMEVGIVELNKNPENYFAEVEQVAFTPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 9170 - protein, 414 aa, Thiobacillus denitrificans
MTADKKPRLRTIQKSTKLDNVCYDIRGPVMARARQMEEEGQRIIKLNIGNPAPFGFEAPEEIVQDVILNLPNASGYSDSKGLFAARKAIMHETQRKGIAGVTIDDIIVGNGVSELIVMAMQALLNNGDEVLVPAPDYPLWTAAVSLGGGKPRHYLCDEGAGWLPDLDDIRAKITPSTRAIVIINPNNPTGALYPTELLREILEIARQHQLIVYADEIYDKVLFDGVVHTSIASLADDLLIVTFNGLSKNYRACGYRSGWLVVSGDKRHAKDYLEGLNMLASMRLCSNVPGQHAIQTALGGYQSINDLVAPSGRLTRQRDLAHELLTLIPGVSCVKPKAAMYLFPRLDPKLYPIHDDQKFILNLLEEERVLVVQGTGFNWPRPDHLRVVFLPHEEDLTEAIGRMSRFLDRQRAHR

SEQ ID NO: 9171 - protein, 478 aa, Listeria monocytogenes
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLSSAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 9172 - protein, 396 aa, Hedycarya angustifolia
DLEPVNPADVPVTAAGALKSYKLAAKAISKLQSLPSGNISVLCDVLVREVSELTGYDRVMAYKFHDDEHGEVIAECRRSNLEPYLGLHYPATDIPQASRFLFMKNKVRMICDCSAPPVKVIQDKSLAQPLSLGGSTLRAPHGCHAQYMANMGSIASLVMSVTINEDDDETSSGSEQQQQKGRKLWGLVVCHHTSPRFVPFPLRYACEFLIQVFGIQLNKEVELAAQMREKHILRTQTVLCDMLLLDAPVGIITKTPNVMDLVKCDGAALYYLNQFWLLGTTPTEAQIRDIVSWLQEYHNGSTGLSTDSLMEANYPGAFVLGDAVCGMAAVRITSKDFLFWFRSHTAKEIKWGGAKHNIVDKDDDGRKMHPRSSFKAFLEVVKRRSLPWEDIEMDAI

SEQ ID NO: 9173 - protein, 542 aa, Triticum aestivum
  misc_feature (407)..(407): Xaa can be any naturally occurring amino acid
MAYGLKPKAPSVPPPGEENDQPIDRPRPKPLSIRGRPPLHSGFGEAAHGIWPVKMDGNTRGGGHSEALKNYNLGKTLGHGTFGKVMIAEHKLTGQKVAIKILNRHQMEIMEMVEKAKREIKILRSFIDFIHPHIIRVYEVIETPKDIFVVMEYCQNGDLLDYIVEKGRLQEDVARRIFQQIISGVEYCHTNMVVHRDLKPENLLLDSKYNVKLADFGLSNVMHDGHFLKTSCGSINYAAPEVISGELYAGPEVDVWSCGGGFYILPNHLSDLAMDLIPRMLIVDPMKRITICEIRDHPWFQNRLPPRRAVPPPDTAQQAKMEIDEDTLQEVANLGYDKDHVCESLCNRLQNEATVAYYLLLDNRFRATSGYLGADYLQSMGRSFNQFTSSESASPSTRQYLPASNGXSKAVALRPYYPVQRKWALGLQSPAHPREIMIEVLKALQELNVRWKKNGHHNMKCRWCPGFPQVSDMLDANHSFVDGSTIMDIGDANGRLPAVIKFEIQLYKTKDDKYLLDMQRVTGPQLLFLEFCAAFLTNLRVL

SEQ ID NO: 9174 - protein, 398 aa, Hernandia lychnifera
DFEPVKPYEVPMTAAGALQSYKLAAKAIARLQSLSSGSMQKLVDTVVEEVYELTGYDRVMAYKFHDDDHGEVISEIKKPDLEPYLGLHYPATDIPQASRFLFMKNKVRMICDCNMKPVKVYLDEKLTYDLTLCGSTLRAPHSCHLQYMANMGSIASLVMAVVINEGEEERIAQKLHNHHHSQKRKRLWGLVVCHHTTPRFVPFPLRYACEFLMQVVAIHVNKEFELENQIQEKNILRTQTLLCDMLLRDAPLGIVTQSPNIMDLVKCDGAALLYGNKIWKLGTTPTELQIRDISLWLSEYHMDSTGLSTDSLYDAGYPGALSLGDAICGMAAVTITPKDFLFWFRSHTAAKVRWGGAKHDPTDKDDGRTMHPRSSFKAFLEVVKTRSLPWKDYEMDAI

SEQ ID NO: 9175 - protein, 345 aa, Hernandia lychnifera
DLEPVNPAEVPVTAAGALKSYKLAAKAISLLLSLPSGNISVLCDVLVCEVSDLTGYDRVMAYKFHEDEHGEVIAECCRPDLEPYLGLHYPATDIPQASRFLFMKNKVRMICDCSAFPVKVVQDKRLAQPLSLCGSTLRAAHGCHAQYMANMDSVASLMMSVTIIEDDDEVGSDPQQQQKGRKLWGLVVCHHTSPRFVPLPLRYACELLIQVFGMQLNKEVELANQMREKHILRMQAVPCDMLLRDTPVGIMTRSPNIMDLVKCDGAALYYHNQFWLLGINPTEAQIRDIARWLLERHNGSTGLSTDSLMEAGYPGASFLGNAVCGMAAVRISSNDFLSWFRSHTA

SEQ ID NO: 9176 - protein, 677 aa, Xanthomonas campestris
MATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVLAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 9177 - protein, 392 aa, Houttuynia cordata
  misc_feature (248)..(248): Xaa can be any naturally occurring amino acid
DLEPVNPSDVPVTAAGALKSYKLAARAISRLQSLPSGDISLLCDVLVREVSDLTGYDRVMAYKFHEDEHGEVVAECKRADLEPYLGLHYPATDIPPASRFLFMKNKMRMICDCLAQPVKVIQDKRLPQPLSLAGSTLRAPHGCHAQYMSNMGSIASLVMSVVVSEGDDDSNNGEKTGRKLWGLVVCHHTSPRFIPFPLRYACEFLIQVFAIQLSKEVELAAQMKEKHILRMQTVLCDMLLRDAPMGIXTQSPNVMDLVKCDGAALYYRCQCWLLGTTPTENQIRDLAEWLLQYHNSSTGLSTDSLVDAGYPGAHELGDAVCGMAAIRITSRDFLIWFRSHTAKEIKWGGEKHDPSDKDAFESKMNPRTSFKTFLEVVKRRSLPWEDVEMDAI

SEQ ID NO: 9178 - protein, 311 aa, Triticum aestivum
MATHFVLNTGAKIPSVGLGTWQSDPGVVGEAVYAAVKAGYRHIDCARAYNNEKEVGLALKKLFEEGVVKREDLFITSKLWCGHHAPEDVPEALGDSLNDLQLDYLDLYLIHWPFRVKKGTSIGNPENFLPPDIPATWGAMEKLHDAGKARAIGVSNFASKKLGDLLAVARIPPAVDQVECHPGWQQSKLHSFCQSAGVHLSAYSPLGSPGSTWMNGNVLKEPVVLSIAEKLGKTPAQVALRWNIQMGHSVLPKSVSEERIKQNLAVYDWSIPEDLLAKFSEIKQARLLMGNFIVNKDSVYKTHDELWDGEI

SEQ ID NO: 9179 - protein, 414 aa, Idiospermum australiense
SGKPFYAIIHRVTGSLIIDFEPVKPYEAPMTAAGALQSYKLAAKAITRLQSLPSGSMERLVDTVVQEVFELTGYDRVMAYKFHEDDHGEVISEITKPGLEPYLGLHYPATDIPQAARFLFMKNKVRMICDCHARPVKVYQDEKLTFDLTLCGSTLRAPHSCHLQYMENMDSIASLVMAVVINEGEEDDEVESAQQQQQKRKRLWGLVVCHNTTPRFVPFPLRYACEFLMQVFAIHVSKEFELENQLREKNILRTQTLLCDMLLRDAPLGIVTQSPNIMDLVKCDGAALLYGSKIWRLGLTPTDSQIQDIAMWLSEYHMDSTGLSTDSLYDAGYPKALSIDDVVCGMAAVRITAKDMLFWFRSHAAAEVRWGGAKHDPSDKDDGRRMHPRSSFKAFLEVVKTRSLPWKDNEMDAI

SEQ ID NO: 9180 - protein, 395 aa, Idiospermum australiense
DLEPVNPADVLVTAAGGLKSYKLAAKAISKLQSLPSGNISLLCDVLVREVSELTGYDRVMAYKFHEDEHGEVIAECRRSDLEPYIGLHYPATDIPQASRFLFRKNKVRMICDCLAPPVKVIQDKRLAQPLSLCGSTLRAPHGCHAQYMANMNSIASLVISVTVHEDDNETGSEQQQQPKGRKLWGLVVCHHTSPRFVPFPLRYACEFLIQVFGIQLNKEIELAAQMNEKHILRTQTVLCDMLQRNAPVGIITQTPNVMDLVKCDGAALYYRNQFWLLGTTPTEAQIRDIVEWLMEYHSSSTGLSTDSLMEAGYQGAAILGDAVCGMAAIRITSKDFLFWFRSHTAKEIKWGGAKHDPVDQDDDGRKMHPRSSFKAFLEVVKRRSLPWEDVEMDAI

SEQ ID NO: 9181 - protein, 390 aa, Lactoris fernandeziana
PYEVPMTAGALQSYKLAAKAISRLQSLPSGSMERLVDTVVQEVFELTGYDRIMAYKFHEDDHGEVISEVTKPDLEPYLGLHYPATDIPQASRFLFMKNKVRMICDCRAKPVKVYQDEKLSFDLTLCGSTLKAPHSCHLQYMENMGFIASLVMAVVVNEGEEEVDSQESSQQQAPKRKRLWGLVVCHNTTPRFVPFPLRYACEFLMQVFAIHVNKEFELENQILEKNILRTQTLLCDMLFRDAPMGIVTQSPNIMDLVKCDGAVLLYQNKVYRLGLAPTESQIHDIAQWLSEYHKDSTGLSTDSFHDAGYTRARSLGDIVCGMAAVRINSGDMLFWFRSHTAAEVRWGGAKHDPDEKDDGRRMHPRSSFKAFLEVVKYRSFPWKDYEMDAI

SEQ ID NO: 9182 - protein, 341 aa, Lactoris fernandeziana
DLEPVNPSDVPVTAAGALKSYKLAAKAISRLQSLPSGNIPLLCDVLVREVSDLTGYDRVMAYKFHEDEHGEVIAECKRSDLEPYLGLHYPATDIPQASRFLFTKNKVRMICDCSARPVKVIQDKRLAQPLSLGGSTLRAPHGCHAQYMLNMGSVASLVMSVTISEDDDDSASEQKGRKLWGLVVCHHTTPRFIPFPLRYACEFLIQVFGIQLNKEVELAAQVREKHILRTQTVLCDMLLRNAPVGIMTKSPNVMDLVNCDGAALYYRNRCWFLGTTPTESQIRDLAEWLLQYHNSTTGLSTDSLVEAGYPCAHGFGEAVCGMAAVKITSRDFLFWFRSHTA

SEQ ID NO: 9183 - protein, 540 aa, Unknown
  Frankia sp. CcI3
MPKIIAFDEEARRGLERGMNQLADAVKVTLGPKGRNVVLEKKWGVPTITNDGVSIAKEIELEDPYEKIGAELVKEVAKKTNDVAGDGTTTATILAQALVREGLRNVAAGANPLGLKKGIEVAVERVSEELSKQAKEVETKEQIASTASISAGDSAIGGLIAEALDKVGKEGVVTVEESNTFGLELELTEGMRFDKGYISPYFVTDADRQEAVLDDPYILIVNSKISAVKDLLPLLEKVMQTGKPLAIIAEDVEGEALATLVVNKIRGTFKSAAVKAPGFGDRRKAILGDIAILTGGQVISEDVGLKLESTSLDLLGRARKIVVTKDETTVVEGAGDPDQIAGRVSQIRNEIEKSDSDYDREKLQERLAKLAGGVAVIKVGAATEVELKEKKHRIEDAVSNAKAAVEEGIVAGGGVALLQASITAFEKLDLSGDEATGANIVRLALEAPIKQIAFNSGLEGGVVVEKVRNLPTGHGLNAATGEYVDLIGTGIIDPAKVTRSALQNAASIAGLFLTTEAVIADKPEKNPAPAVPGGGGDMDF

SEQ ID NO: 9184 - protein, 393 aa, Lemna gibba
DLEPVNPSDVPVTAAGALKSYKLAAKAISRLQSLPSGNISLLCDVLVREVKDLTGYDRVMAYKFHEDEHGEVVSECRGSDLEPYLGLHYPATDIPQASRFLFLKNKVRMICDCSAQPVRIIQDKRLSQPLSLCGSTLRAPHGCHAQYMKNMGSIASLVMSVTINDEGVDHGGEEQQKSRKLWGLVVCHHSSPRFIPFPLRYACEFLMQVFAIQVNKEVEIAAQKREKHILKTQTFFCDMLLREAPVGIFTQSPNVMDLVKCDGAALYYRNQFRLLGVTPTEAQIKDLCDWLMDWHNNTTGLSTDSLSEAGFPGASSLGDAVCGMAAIKITGKDFVFWFRSHVAKEIKWGGAKDESVGRSEEGRKLYPRSSFQAFLEIVKRRSLPWEDVEMDAI

SEQ ID NO: 9185 - protein, 397 aa, Gibberella zeae
MTLSKTTTTVNPESRLFKPIQVGNAKLDHRIVMAPLTRYRNDDNHVVKPFVERYYAERASAPGTLVIAEATGVSMQDTGMRQGPAFVTDEQVAGWTKVISAVHEKKSFWAQQIWGQGRASDPEYQKERGFKYRSSSAVPIEEGAPAPEAMTEEEIQQFIQDMVATSRRVIDAGGDIVEVHAAHGYLIDQFTSDSINKRTDKWGGSVENRARLLLEVIKAVSAEVGPEKVAIRLSPYATFQGSESSDVKEQYTYIVSELKKIGALAYLSLVEARGDPAKLLAPDQDASTDSKTLDFILDIWDNTSPVIVAGNYSPESAAEVLDGHYSKWDVLVAFGRHFIANPDFVWRVKHGVELTKYDRTTFYVRGSEIGYNDYPFSQEYVNEQRAWAVKNLKMHAK

SEQ ID NO: 9186 - protein, 672 aa, Unknown
  Shewanella sp. MR-7
  misc_feature (49)..(49): Xaa can be any naturally occurring amino acid
MSFPHLLEPLDLGFTQLKNRVLMGSMHTGLEEEKGGFEKLAAFYKERAXGGVGLIVTGGISPNLRGRLTPHACQLSFPWQVGKHRIVTQAVHEADGKICMQILHAGRYGYHPFSQAPSKIKSPITPFTPSAMSSRQVRATIKDYASSAALAKRAGYDGVEVMGSEGYLINQFISSRTNTRTDEWGGSFEKRAQFPIEIVNAIRAKVGNDFIIIFRLSMLDLVDNGSTWDEVVQLAKWLEHAGVSIINTGIGWHEARVPTIATSVPRGAFAWVTEKLKKSVSVPLIATNRINTPEIGEQIIASGQADMVSMARPFLADPEFVNKAAANTPELINTCIGCNQACLDHTFSLKRATCLVNPRACYETEINFLPTHNKKRIAVMGAGPAGMAFSVYAAMRGHEVALFEAKSEVGGQFNLARKIPGKEEFNETIRYFLNQIKLHKIDLRLNTRLDAKVLESETFDEIVIASGVVPRELSLPGFDSPKVVDYQQVLTGQATIGNKVALIGAGGIGFDMAHYLCESESSTLNPEKWLKQWGIDKQYQHAGGLAEPEVDNSEHRQVYLLQRKTSKMGQGLGKTTGWIHRLVLKQHDVKMKTGVSYDKFDDAGLHIRVGEQTEVLAVDNVILCAGQESNRTLVDEMKATGIPVHLIGGVDVAAELDAKRAIRQGAELAMRL

SEQ ID NO: 9187 - protein, 351 aa, Xanthomonas campestris
MATMAAHFLHRLPVPMSRPSLTRFLIEEQHAGRIDAELRQLITIVSRACKRISIAVSKGTLGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 9188 - protein, 133 aa, Gibberella zeae
MVNPPKQGQPSYELYKKEYDGIFTGLQERATALHKAFSQMEGVECAEPQGSMYLFPTINLPAKAAEAAKAEGRSADEFYCMRLLEATGICVVPGSGFGQKENTLHFRTTFLAPGTEWVGRIVKFHNEFLDKYR

SEQ ID NO: 9189 - protein, 547 aa, Campylobacter rectus
MAKEIFFSDEARNRLYEGVRKLNDAVKVTMGPRGRNVLVQKSFGAPAITKDGVSVAKEIELKDALENMGAGLVKEVASKTNDEAGDGTTTATVLAHSIFKEGLRNITAGANPVEVKRGMDKQAAAIIAELKNLSRKVTDKKEIAQVATISANSDSAIGGLIADAMEKVGKDGVITVEEAKSIQDELNVVEGMQFDRGYLSPYFITNAEKMQVELQSPYILLFDKKITNLKDLLPVLEQIQKTGKPLLIIAEDIEGEALATLVVNKLRGVLNISAVKAPGFGDRRKAMLEDIAILTGGEVVSEELGRTLESATLSDLGQASSVIIDKDNTTIVNGAGEKSAIDARIIQIKAQIAETTSDYDKEKLQERLAKLSGGVAVIKVGAATETEMKEKKDRVDDALSATKAAVEEGIVIGGGAAFIKAGAKVDLNLSGDEAIGADIVRRALTAPLRQIAENAGFDAGVVANSVSVSKDDNYGFNAATGEYVDMFKAGIIDPVKVERIALQNAVSVASLLLTTEATISELKEDKPMPAMPDMSGMGGMGGMGGMM

SEQ ID NO: 9190 - protein, 248 aa, Oryza sativa
  misc_feature (117)..(117): Xaa can be any naturally occurring amino acid
  misc_feature (194)..(194): Xaa can be any naturally occurring amino acid
HLLVPGIRPLWPGSSPLGGGEVFLRVPNIKSTLKAANWADEGMVKRIRGVSFSTRVSPQIENRIIYAARGIFNRFIPDVPIFTDHRSGSAGGRSAGYGVSVIAETTTGCLLSADATXASMLLKEIAPRGVVDSAHQGLLFILCALSPPDVSKVRVGQLTPYAIETLRNIRDFLDVQFIIKPDPNSHTVTLPCVXGAGVNNLSRKTSSNPRLSIPSRLTLSAQHGPRNPRLILNPSDSPTSRLQLAHPD

SEQ ID NO: 9191 - protein, 219 aa, Arabidopsis thaliana
MAQQSLIYSFVARGTVILVEFTDFKGNFTSIAAQCLQKLPSSNNKFTYNCDGHTFNYLVEDGFTYCVVAVDSAGRQIPMSFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGSQMRRKMWLQNMKIKLIVLAIIIALILIIVLSVCHGFKC

SEQ ID NO: 9192 - protein, 336 aa, Oryza sativa
  misc_feature (250)..(250): Xaa can be any naturally occurring amino acid
MESIARYLSRDLPYELSADDVYLTSGCAQAIEIICSVLARPGANILCPRPGYLFHEDARVNGMEVRYFDLLPESGWEVDLDGVQELADKNTVAMVIINPGNPCGNVYTSEHLAKVAETAKKLGIFVIADEVYAHLTFGQNKFVPMGVFGSVAPVLTLGSISKRWVVPGWRLGWIVTSDPNGVFQRTKVVESIQSYLDISADPATFIQGAIPQLIENTKEEFFEKTVDVLRQTADICWEKLKGISCITCPXKPEGSMFVMVKLDLSCLQGIKDDMDFCCQLAKEELVILLPGCAVGYKNWLRITFAIEPSSLEDGIDRLKSFCSRHSKPKVHRSLET

SEQ ID NO: 9193 - protein, 471 aa, Oenococcus oeni
MVAISLLITESEYISHGRIKEGVFWGNSTSSMQTEGAWNEGGKGMSVYDIKPSGPDNSDWKVAIDEYHRYPEDVNIMQNLGMNFYRFQISWSRVQPEGEGDFNQTGIDFYNRLIDNLLKAGIEPMICLYHFDMPLALAKKYNGFLNQKVVSAFFEYAKKMIEKFGDRVKYWITFNEQNCFSLSSAFESSGYLTGKKTLRELYQIQHNTILAHCLVANYIHQSKPDLKIGGMEAFQEAYPYSPLPTDVEVTRKYKEFVDYNLLRVFVEGKYSTEVIGFMKENHLEDILKPSDLLEIGNNRSDFISFSYYTTSTLDSSQIPVGSIPNYYGQMGYKKNPYLLSNEWGWQIDPQGFYGILIDLYNRTHLPIFPIENGIGVRENWDGQNQIDDSYRVQYHRSHIRALKKAVRDGANVIGYLGWGLIDIPSSKGNVDKRYGVVYVNRTNHEILDLKRVPKKSYYWLQKVIKSNGTEL

SEQ ID NO: 9194 - protein, 404 aa, Streptococcus pneumoniae
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDTDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 9195 - protein, 398 aa, Kluyveromyces lactis
MSFMNFEPKPLADTDIFKPIKIGNTELKHRVVMPALTRMRALHPGNVPNPDWAVEYYRQRSQYPGTMIITEGAFPSAQSGGYDNAPGVWSEEQLAQWRKIFKAIHDNKSFVWVQLWVLGRQAFADNLARDGLRYDSASDEVYMGEDEKERAIRSNNPQHGITKDEIKQYIRDYVDAAKKCIDAGADGVEIHSANGYLLNQFLDPISNKRTDEYGGSIENRARFVLEVVDAVVDAVGAERTSIRFSPYGVFGTMSGVSDPVLVAQFAYVLAELEKRAKAGKRLAYVDLVEPRVTSPFQPEFEGWYKGGTNEFVYSVWKGNVLRVGNYALDPDAAITDSKNPNTLIGYGRAFIANPDLVERLEKGLPLNQYDRPSFYKMSAEGYIDYPTYEEAVAKGYKK

SEQ ID NO: 9196 - protein, 391 aa, Unknown
  Magnolia x soulangeana
DFEPVKPYEVPMTAAGALQSYKLAAKAIARLQALSSGSMEKLVDTVVQEVFELTGYDRVMAYKFHEDDHGEVISEITKPGLEPYLGLHYPATDIPQAARFLFMKNKVRMICDCNAKPVKVYQDEKLTFDLTLCGSTLRAPHSCHSQYMENMSSIASLVMAVVINEGVDEEEGMEPAQQEQQQLKRKRLWGLVVCHNTTPRFVPFPLRYACEFLMQVFAIHVNKELELENQIQEKNILRTQTLLCDMLLRDALVGIRTQNPNIMDLVKCDGAALFYNNKIWRLGLTPTDSQMRDISVWLSEYHMDSTGLSTDSLYDAGYPGALALGDVVCGMAAVRINPKDMLFWFRSHTAAEVKWGGAKHDPSDKDDGRRMHPRSSFKAFLEVVKTKSLPW

SEQ ID NO: 9197 - protein, 450 aa, Zea mays
MDIKDMKTRGKTLTERYELGKLLGKGAFGKVHYGRDLESNQDVAIKIMDKDRVLKAGLSEQVKCEITTMRLVTHKNIVRLHEVMATRNKIYIIMEYAKGGELFEKIKRSDRLTEADTHKYFQQLIDALDHCHSRGVYHRDLKPENLLLDENGDLKVSDFGLSAFSESRRTDGLLHTVCGTPVYIAPEVIKKTGYDGAKSDIWSCGVVLFVLAAGYLPFQGPNLMEIYRKIHDRDFRCPSWFSHKLKRLLYKILNPNPSMRPSIQEIKESTWFRKGPREISAVNEKVLSENATTTNAAPVLPSRRKEIAHEDMKSLVATNLNAFEIIALSAGLDLSGLFIKECRKETRFTSDKPALSIIAKLEDVAKALNLRIRKKDNNTISIQGRKEGGNGVLKFDTQIFEITPSCHLVQIKQTSGNLLEYEKLLEEGIRPGLKDVVSAWHGDDLQQKQK

SEQ ID NO: 9198 - protein, 358 aa, Unknown
  Magnolia x soulangeana
PFYAIVHRIDIGLVIDLEPVNPADVPVTAAGALRSYKLTAKAISRLQSLPSGNISLLCDVLVREVSELTGYDRVMAYKFHEDEHGEVIAECRGSDLEPYLGLHYPATDIPQASRFLFMENKVRMTCDCLAPPVKVIQDKKLAQPLILCGSTLRAPHGCHSQYMANMGSIASLVMSVTINEDDDDDTSVSNGRRRKLWGLVVCHHTSPSFVPFPLRYACEFLVQVFGIQLNKEVELPAQMREKHILRMQTVFCDMLLRDAPVGIITQSPNVMDLVKCDGAAFYYRNQFRLLGTTPTEAQIRDIAGWLLEYHDGTTGLSTDSLTEAGYPGAADLGDDVCGMAAIKITSKDYLFWFRSHTA

SEQ ID NO: 9199 - protein, 389 aa, Nelumbo nucifera
PYEVPMTAAGALQSYKLAAKAIARLQALPSGCMDRLCDTVVQEVFELTGYDRVMAYKFHEDDHGEVVSEITKPGLEPYLGLHYPATDIPQAARFLFMKNKVRMICDCRAKHVKVLQDEKLPFDLTLCGSTLRAPHSCHLQYMENMDSIASLVMAVVVNEGDEEGEASGSSQQQKRKKLWGLVVCHNTTPRFVPFPLRYACEFLIQVFAIHVNKEIELENQILEKNILRTQTLLCDMLMRDALLGIISQSPNVMDLVKCDGAALLYKNKIWQLGTTPTEFQIHDIASWLSEYHMDSTGLSTDSFYDAGFPGALSLGDAVCGMAAVRITSKDMLFWFRSHTAAEVRWGGAKHDPDEKDDGRRMHPRSSFKAFLEVVKTRSLPWKDYEMDAI

SEQ ID NO: 9200 - protein, 391 aa, Nelumbo nucifera
DLEPVNPADVPVTAAGALKSYKLAAKSISRLQSLPSGNISLLCDVLVREVSDLTGYDRIMVYKFHEDEHGGVVAECRRPDLESYLGLHYPATDIPQASRFLFMKNKVRMICDCLAPPVKVIHDKKLAQPLSLCASTLRVPHGCHAQYMANMGSIASLVMSVTINDDDNEMESDQPKGRKLWGLVVCHHTSPRFVPFPLRYACEFLVQVFGIQLDKEVELAAQLREKHILKTQTLLCDMLLRNAPVGIFTESPNVMDLVKCDGASLYYKNKFWLLGITPTEAQIRDIAGWLLEHHDGSTGLSTDSLMEAGYPGASVLGDAVCGMAAIKITSKDFLFWFRSHTAKKIKWGGAKHDPVVKDGGRKVHPRSSFKAFLEVVKRRSLPWEDVEMDAI

SEQ ID NO: 9201 - protein, 580 aa, Oryza sativa
HFLSSSSPLNPQFLLLPRQSARLRVLLSIPVSAMSSSSSSSSRGALAAAAVPSLSADEAGAAADEAFLRYTSPSMRRSGGGGVAIVWFRNDLRVLDNEAVVRAWAASDAVLPVYCVDPRISAGSTHYFGFPKTGALRAQFLIECLEDLKRNLTKQGLDLLIRHGKPEDILPSIAKAVTAHTVYAHKETCSEELLVEHLVRKGLEQVVIPQGGASNQKKPRNPKLQLIWGATLYHVDDLPFSVNNLPDVYTQFRKAVESKSSVRNCSKLPPSLGPPPGSGLDEIGGWGTVPTLESLGLSMTKSEKGMHFVGGESAALGRVHEYFWKKDQLKVYKETRNGMLGPDYSTKFSPWLASGSLSPRYICEEVKRYEKQRIANDSTYWVLFELIWRDYFRFISAKYGNSIFHLGGPRNVESKWSQDQALFESWRDGRTGYPLIDANMKELLATGFMSNRGRQIVCSFLVRDMGIDWRMGAEWFETCLLDYDPASNYGNWTYGAGVGNDPREDRYFSIPKQAKTYDPDGEYVAYWLPELRSIAKERRNFPGASYIKQVVPLKFDGGHQKRDQQFNRQRRPGHMYRRQK

SEQ ID NO: 9202 - protein, 415 aa, Nymphaea odorata
GKPFYAIVHRVVSGLVMDFEPVKPSELPITAAGALQSYKLAGKAISRLQSLPGGSITRLCDTVVEEVHQLTGYDRVMTYKFHDDDHGEVVSEIRKPDLEPYLGLHYPATDIPQAARFLFMKNKVRMICDCRAKPVKVYQDENLKTDLTLCGSTLRAPHSCHLQYMENMSSIASLVMAVVINEGEDEGEDETDPNQRSQKRKRLWGLVVCHNTSPRFVPFPLRYACEFLAQVFAIHVNKEVELENQNALKKNILRTETLLCDMLLRGSPLGIVSQTPNIMDLVKCDGAAFLYGSKLYLLGRTPAESQIRDIAIWLSEYHKDSTGLSTDSLCEAGYPGALAIGSPVCGMAAVRITANDMLFWFRSHTASEIRWGGAKHDPEEKDDGRRMHPRCSFKAFLEVVKTRSLPWKDFEMDAI

SEQ ID NO: 9203 - protein, 155 aa, Zea mays
MSLVRRSSVFDPFSVDLFDPFDSMFRSIVPSSSSAAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 9204 - protein, 407 aa, Nymphaea alba
PFYGILHRIDVGLVIDLEPVNPTDVPVTAAGALKSYKLAAKAISRLQALPSGNIGLLCDVLVREVSELTGYDRVMAYKFHEDHHGEVIAECKKPDLEPYLGLHYPATDIPQASRFLFMKNKVRMICDCTAPSVKVIQDKQLEAAVELCGSTLRSPHGCHAQYMVNMGSIASLVMSVVIMNHDEEPANDNPQKGSKLWGLVVCHHTSPRFIPFPLRYACEFLIQVFAVQLNKEVELAAQLREKHILRTQTVLCDMLLRDAPVGIVTPSPNVMDLVKCDGAALYYGKQFWLLGTTPTETQVRDIAGWLYECHGGSTGLSTDSLMEAGYSGAVALGDAACGMAAVKITYRDFLFWFRSHTAKEIKWGGAKHDTVDKDAGKRMHPRSSFKTFLEVVKHRSHPWENAEMDAI

SEQ ID NO: 9205 - protein, 432 aa, Methanocaldococcus jannaschii
MRNPIIDVGAKELSYEIREIVDVAKKIEEFGINITWENIGDPVAKGEKIPDWIKDIIAEIVKNDCSYAYCPTKGLLETREFLAEQVNKRGGVQITAEDIIFFNGLGDAIAKIYGLLKRQVRVINPSPSYSTHSSAEASHAGSPPVTYFLDPYNYWYPDIDDLEKRIKYNPAVSGILVINPDNPTGAVYPKKILNEIVDLANEYDLFIICDEIYCNLVYNGKKQHLLCEVIDDVCGLSLKGISKELPWPGARCGWIEIYNADKDEEFKKYVESIYKAKLIEVCSTTLPQMAIPRIMGHRNYKKYLEERNRFFEKRSNTAYKKLKDLDGVIANKANGAFYMSVVFEDNYLNGNNSIKIENEKLKEFIEHQIKDASIDKKFVYYLLASTGICVVPLTSFCSQLNGFRVTLLERDDEKFEWIFDTLAEKIDEFLKT

SEQ ID NO: 9206 - protein, 448 aa, Piper nigrum
SGKPFYAIVHRVTGSLIVDFEPVKPLEVPMTAAGALQSYKLAAKAISRLQSLPSGGMERLVDTVVQEVFELTGYGRVMAYKFHEDDHGEVISEVTAPDLDPYLGLHYPATDIPQAARFLFMKNKVRMICDCHAKPVKVYQDEKLPFDLTLCGSTLRAPHSCHLHYMANMGSIASLVMAVVINEGACSSATDHAVEQHSSSSSSSASYAAATATAAAAGGGGGSNIDTTSATSRRKMLWGLVVCHNTKPRFVPFPLRYACEFLMQVFAIHVNKELELERQIREKNILRTQTLLCDMLLRDAPMGIVNQSPNIMDLIKCDGAALLYKQQVFPLGVAPSDAELRQLARWLSSSHRDSTGLSTDSLHDAGYPNASCLGNVVCGMAAVKITPSDLLFWFRRHTAAEVRWGGAKHHPTDRDDGKRMHPRSSFKAFLEVVKTRSLPWQNYEMDAI

SEQ ID NO: 9207 - protein, 469 aa, Arabidopsis thaliana
MGLLSKKASCNTHGQDSSYFWGWEEYEKNPYDEIKNPDGIIQMGLAENQLSFDLIESWLAKNPDAANFQREGQSIFRELALFQDYHGLPSFKNAMADFMSENRGNRVSFNPNKLVLTAGATPANETLMFCLADPGDAFLLPTPYYPGFDRDLKWRTGAEIVPIQCKSANGFRITKVALEEAYEQAQKLNLKVKGVLITNPSNPLGTTTTRTELNHLLDFISRKKIHLISDEIYSGTVFTNPGFISVMEVLKDRKLENTDVFDRVHIVYSLSKDLGLPGFRVGVIYSNDDFVVSAATKMSSFGLISSQTQYLLSALLSDKTFTKNYLEENQIRLKNRHKKLVSGLEAAGIECLKSNAGLFCWVDMRHLLKSNTFEAEIELWKKIVYEVKLNISPGSSCHCNEPGWFRVCFANLSEETLKVALDRLKRFVDGPSPTRRSQSEHQRLKNLRKMKVSNWVFRLSFHDREPEER

SEQ ID NO: 9208 - protein, 341 aa, Piper nigrum
DLEPVNPADVPVTAAGALKSYKLAAKAISRLQSMPNGDIALLCDVLAREVSDLTGYDRVMAYKFHEDEHGEVIAECKRSDLEPYLGLHYPATDIPQASRFLFMKNKVRMICDCLAPPVKVVQDKRLGQPLSLAGSTLRAPHGCHSQYMSNMGSIASLVMSVMVCEGDEDSNGEKTARKLWGLVVCHHTSPRFIPFPLRYACEFLIQVFAIQLSKEVELAAQVKEKHVLRMQTVLCDMLLRDAPMGIMTQSPNVMDLVMCDGAALYYHSQCWLLGATPTENMVRDIAEWLQQYHGTSTGLSTDSLVEAGYPGAHELSDAVCGMAAITITNRDFSFWFRSHTA

SEQ ID NO: 9209 - protein, 394 aa, Unknown
  Sagittaria sp. Mathews 383
PYEVPMTAAGALQSYKLAAKAISRLQSLPGGSMQKLCDTVVQEVFELTGYDRVMAYKFHEDDHGEVVSEVTKPGLDPYLGLHYPATDIPQAARFLFMKNKVRMICDCRAKPVKVYQDEKLAFDLTFCGSTLRAPHSCHLQYMENMDSIASLVMAVIVNEGDEEDEVLGSRAQQQQQQQQRRKRLWGLVVCHNRTPRFIPFPLRYACEFLMQVFAIHVNKEFELENQMREKNILRTQTLLCDMLFRDALLGIISQNPNIMDLVRCDGAALVYQSKIWRLGMAPTESQICDIAAWLSEYHMDSTGLSTDSLHDAGYPGVLALGDSVCGMAAARITSKDILFWFRSHTAAEIRWGGAKHDPADEDDGRRMHPRSSFKAFLEVVKTRSMPWKDYEMDA

SEQ ID NO: 9210 - protein, 397 aa, Unknown
  Sagittaria sp. Mathews 383
DLEPVNLSDVPVTAAGALKSYKLAAKAISRLQSLSSGNISLLCDVLVREVRDLTGYGRVMAYKFHEDEHGEVISESRRSDLEPYLGLHYPATDIPQASRFIFMKNKLRMICDCTAQPVKVIQDKKFTQPLSLCGSTLRAPHGCHAQYMANMGSIASLVMSATISDEDEDDASSGQQRKRRKLWGLVVCHLTSPRFVPFPIRYACEFFMQVFAIQLNKEVELAAQTMEKYIFRTQTFLCDMLLRDAPVGIFTQSPNAMDIVKCDDAALYYKNQFWLLGITPAEGQIRGIAGWLRDCHNTTTGLSTDSLTAFSEAGYRGASTLGDAVCGMTAIKFTSRDFIFWFRSHTAKEIKWRGAKHDPVDKDDDGRKMHPRSSLKAFLDVVKRRSLPWEDVEMDAI

SEQ ID NO: 9211 - protein, 544 aa, Bartonella bacilliformis
MAAKEVKFGRDARERLLRGVDILADAVKVTLGPKGRNVVIDKSFGAPRITKDGVSVAKEIELENKFENMGAQMLREVASKTNDIAGDGTTTATVLGQAIVQEGVKAVAASMNPMDLKRGIDAAVEAVVADLFKKAKKIQTSEEIAQVATISANGAEDIGKMIADAMEKVGNEGVITVEEAKTAETELEVVEGMQFDRGYLSPYFVTNSEKMMVDLDDPYILIHEKKLSNLQSLLPVLEAVAQSGKPLLIIAEDVEGEALATLVVNKLRGGLKIAAVKAPGFGDRRKAMLEDIAVLTSGQVISEDVGIKLENVTLEMLGRAKKVHVSKETTTIVDGAGQKSEINARVSQIKAQIEETTSDYDREKLQERLAKLAGGVAVIRVGGSTEVEVKEKKDRVDDALNATRAAVEEGIVPGGGTPLLRAAKALSIKGKNPDQEAGIGIIRRALQAPARQIAHNAGEEAAVIVGKVLENCSDTFGYNTATAQFRDLISFGIVDPVKVVRSALQNAASIASLLITTEAMVAEVPKKEAAAPAMPGGGMGGMDF

SEQ ID NO: 9212 - protein, 613 aa, Xanthomonas axonopodis
MCGIVALRSFVAEAPLQALAERALDALSRRGPDAQGLLCLEQPVPTALGHRRLAILDLSAAATQPMRCAETGNVLVFNGEIYNFLELRRELEGLGHQFRTDSDTEVILHGWRAWGEGLFPRCNGMWALVLLEQASGDLIYCRDRLGVKPLYLHHDGRQLVLASEIRAIAASLGGYPPPNPAAVFDFLVTGLSDHTSDTFYAGIRAVPPGWLYRVSPAGHSRRTPYHQWPLPGAVAPLDAQATMELLEDSTRLRLRSDAPTVSLLSGGLDSSILTTLSVQAGALPRTCFAGAFTYGYDDTEQAGFDETEAAASLMQTLGQSERHFVHRARAIPDEEELLALVAAQEEPFCTPSILASFRMYRAIRAAGYKVVLNGEGADELFGGYVRLYLALSARSALHQARLPTAIRLLSTGAVDPRLLLNRLAWDLPAGALGALLRRQRPSVACMSSALWHDQAARLQSLQVDRRVDIEARLRRDVLSTNLPMVLRMTDRNSMSAGIEVRAPFLDYRVVERALSTPALQRMGDYHGKAMLRHAFAERLPARVTTQRKSTGFGHAEQFLVDRMPLQQALATLPEGVNELLNVARLRREFASGRSHSTLWFAVSVALWYRSVYA

SEQ ID NO: 9213 - protein, 408 aa, Aquifex aeolicus
MKRISFIPLLILVFFAGFILGQSSENKKEEDKYFYLKLFTEALKIVEREYVEPVPIKKLIYGAIDGMVSSLDPFSDFFTPEEYKEFLSETEGEFGGVGIEITMENGRPVVVSPIEGTPAWKAGIRPGDIIIAVDGEDTFNMSLMEVVKKIRGKPGTKVKLTILRKGEGKPIEVTLVRARIKVPSVKYTNYKGIGYIKISQFTSGTSKSLEKAILELENQNVKGFIIDLRNNPGGLLSEAVDVGDLFIPKGKLIVYTKGRKGELHRYFAEREPITQGLPVVLLVNKGSASASEIVAGALQDYHIATLVGEKTFGKASVQNLIPLSDGSAMKLTIAYYYTPKGRLIHKKGIKPDVEVKMDEETWKKLFETIRKMRFEGHMEKVILLPDIDVQLRKAIEILEKKAKLKKAA

SEQ ID NO: 9214 - protein, 145 aa, Bacillus cereus
MRNLFPEITKRQNSIFDFGPSLLEGMTDAFFKPMNMDTFKVDVHEQSDKYTVKADLPGFQKENIQVEFEQDVLTIQATNHNEVEEKNENGTYIRKERSIGSVTRRFSFKQVEEENVRANYKDGVLTIELPKLKEEKNSKTTINIE

SEQ ID NO: 9215 - protein, 260 aa, Zea mays
  misc_feature (216)..(216): Xaa can be any naturally occurring amino acid
  misc_feature (247)..(247): Xaa can be any naturally occurring amino acid
FGTRPRTVPQRQPWCSRTRAPAGTAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNXETGWDVPIHVDAASGGFIAPFLYPELEWDFXLPLVKSINVSGHK

SEQ ID NO: 9216 - protein, 707 aa, Burkholderia fungorum
MAGKTNTQKPAAKNAQASGPQSDPKAKDLEQFRVSPEGEALRTNQGVKISDNQNTLRAGPRGPSLLEDFIMREKITHFDHERIPERIVHARGSAAHGVFQVYESMQEYTKAAFLQDPAVQTPVYVRFSTVQGPRGSADTVRDVRGFAVKFYTQEGNYDLVGNNMPVFFIQDAIKFPDFVHAVKPEAPNEMPTGGSAHDTFWDFVSLVPESAHMVLWTMSDRAIPRSLRTMEGFGIHTFRFVNAQGKGRFVKFHWRPVLGSYSLLWDEAQKLAGKDPDFHRRDLWESIERGDFPEFELGVQIIEEADEHKFDFDLLDPTKLIPEEQVPVKIIGKMTLNRNPDNFFAETEQVAFHPGHVVPGIDFSNDPLLQGRLFSYTDTQISRLGGPNFHEIPINRPVCPFNNNQRDAMHRQTINVGQASYEPNSLSGGWPKETDPAPSDGGFETYQERVEGTKIRVRSESFADHFSQAALFYNSMSPPEKDHIAAAYQFELGKVTKPEIRARVVNEILANFDAGLAAQVAEGLGLPAPKKGTAKLTGPKESPALSLLNRVKPGIKTRKIALLAAPGSDGAAIKKLQQALQGEGATPMLIAPTLAAIDGMAPDATIAGLPSIMFDAVIVVGGDQGAKALAQSGDARHFVLEAFKHLKAIAAIGAGRDVLAAAHLPHNADGVATGDDKQAAEVLKAFIEAAGQHRVWSRAQQAETVPA

SEQ ID NO: 9217 - protein, 232 aa, Oryza sativa
MTWSSDSDRDDEPATAAAASADDASLATSFFLQQPGTPPAAAPAPARRRRHKNRRPRAHRRAAAKNEEEEEVAGTEDVWRGAQWEAAWPRRAAARPVVVADDAAGAAAAREDAPGVGGEGGGLGVGRARSLTDDDLEELKGCVDLGFGFSYDEIPELCGTLPALELCYSMSQRFLDEHHHSPEAEPAPVAPSSPAQPIANWKISSPGDSPDEVKARLKYWAQAVACTVRLCS

SEQ ID NO: 9218 - protein, 548 aa, Spirodela punctata
MGVCFSKASKPSGNGYQPPPPQPYKPPPPPAARPAQPSVQIPQTHHTQQRQQSDHQSASQAAPSPAKQHLPSPRNSPAAAVSAATPATVLGKPFEDVKAKYTIGKVLGRGQFGVTYLCTCNSTGAKYACKSISKRKLVNRNDREDVKREIQIMQHLSGQENIVEFKGAYEDRHSVHVVMELCAGGELFDRIIAKGHYSERAAAAMCRSIVNVVNICHFMGVMHRDLKPENFLLSTKDPGAALKATDFGLSVFIEEGKVYRSIVGSAYYVAPEVLMRSYGKEIDVWSAGIIVYILLSGVPPFWGETEKKIFDSIMKDDIDFQSDPWPSISASAKDLVSKMLTRDPKKRITAAQVLDHPWIRVDGEASDKPIDSAVLSRMKQFRAMNKLKKMALKVIAESLSEEEIKGLRQMFQNMDTDQSGTITYEELKTGLARLGSRLSEAEVKQLMDAADVDGNGSIDYIEFITATMHRHKLEREEHLYSAFSYFDKDNSGYITRDELKQALEEHGMGDADSIREIISEVDTDNDGRINYDEFCAMMRSGTHPPGRP

SEQ ID NO: 9219 - protein, 619 aa, Candida tropicalis
MSEQNQGQPDQQHSGDHQHHHHHHHHHHHSQQPAQPIPIDPNVNPANRIGRYQIIKTLGEGSFGKVKLAQHVGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSSGVILYVMLCGRLPFDDEFIPALFKKISNGVYTLPNYLSPGAKHLLTRMLVVNPLNRITIHEIMEDEWFKQDMPDYLLPPDLSKIKTSKIDIDEDVISALSVTMGYDRDEIISVIEKANREAAAGGATPTNQSKSTNEVLDAYLLMKENHTLVKDLKKSKSENIESFLSLSPPPSSSFPNPGSTSSAPGVQQSLTYQTLATVPDLSTLPNSTIAILPTSLPSIHRAYMMETKVNDPQQQIPAPQPTKKLKTRWHFGIRSRSYPLDVMGEIYRALKNLGAEWAKPTEEELWTIRVRWKYDSTPQLRVWQRTNLMKMQIQLFQLEPNNYLVDFKFDGWEQTSDESKNDASLDYKQQDLDEVGSFSAYPFLHLATRLIMELAVNSQSG

SEQ ID NO: 9220 - protein, 741 aa, Pseudomonas syringae
MNAPDKTGTDRRAVPAAVDLDALIRAEHRDPFSILGPHDDGKGGQYVRAYLPAALSVRLLARDDGRELAELHMSDVPGFFVGHLEQPQPYLLKINWAGGEQITEDPYSYGPLLGEMDLYLFAEGNHRDLSSCLGAQVTSVDGVEGVRFAVWAPNARRVSVVGSFNGWDGRRHPMRLRHPTGVWEIFVPRLQPGEVYKYEILGAHGILPLKSDPMALATTLPPDTASKISAPLKFEWHDQDWLQSRAGRHDVAAPLSIYELHAGSWQMEQNDEGQWRQYNWRELADRLIPYVKELGFTHIELMPIMEHPFGGSWGYQLLAQFAPTARYGSPEDFAAFVDACHQAEIGVILDWVPAHFPTDTHGLAQFDGTALYEYADPKEGFHQDWDTLIYNLGRTEVHGFMLASALHWLKHYHIDGLRVDAVASMLYRDYSRKAGEWVPNRFGGRENLEAIDFLRHLNDVVALEAPGTMVIAEESTAWPGVSESTQKGGLGFNYKWNMGWMHDSLQYMEEDPINREHHHGKLSFSLVYAWSERFVLPISHDEVVHGKHSLIDKMPGDRWQKFANLRAYLAFMWTHPGKKLLFMGCEFGQWREWNHDEQLDWYLMQYAEHVGVKKLVGDLNRIYREEKALHQRDADPTGFQWLIGDDKSNSVFAYLRWSNDGEPLLVVANMTPVPREGYRVGVPLQGAWTELLNSDAETYAGSNIGNGGEVISEDEPVHGMSASLTLNLPPLAVLIFKPKKG

SEQ ID NO: 9221 - protein, 425 aa, Xylella fastidiosa
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIAAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKLRSAAA

SEQ ID NO: 9222 - protein, 479 aa, Lactobacillus sakei
MTNQLTTNEGQPWADNQHSQTAGQRGPVLIQDYQLLEKLAHFNRERIPERVVHAKGAGAKGYFKVTKDMSAYTKAAVFSGVGKKTPLITRFSQVAGEAGYPDTYRDVRGFAVKFYTEEGNYDIVGNNTPVFFVNDPLKFPDFIHSQKRDPRTHARSQDMQWDFWSLSPESVHQVTILMSDRGIPASYRMMHGFGSHTFKWVNAQGEQFWVKYHFKTNQGVHNLSNELADELAGKDTDYLQNDLFDAIETGDYPSWTVAVQLVPYEDGLNYPQDIFDVTKVISQKDYPLIEIGQMVLDENPTNNFEDIEELAFSPANLVPGIEASPDKLLQGRLFGYKDAERYRLGANYEQLPINRPKVPVHNYERDGVMAQKQETGVNYEPNSQDGPTEVPAAKIHSDQLSGTTGNFSTDPDYYSAAGKLYRLLSADEQTRLIENIRMNLGQVTKPEIQIREVKQFYQADPEYGRRAATALNLDLAQFE

SEQ ID NO: 9223 - protein, 151 aa, Hordeum vulgare
MSIVRRSNVLDPFADLWADPLDTFRSIFPAISGGNSETAVRERRMDWKGRRLEAHVFKADLPGVKKEEVKVEVEDGNVLIVSGERTKEKEDKNDKWHRVERRSGKFVRPFRLPEDGKVDEVKAGLENGVLTVTVPKAEVKKPEVKAIEISG

SEQ ID NO: 9224 - protein, 485 aa, Arabidopsis thaliana
  misc_feature (53)..(53): Xaa can be any naturally occurring amino acid
  misc_feature (215)..(215): Xaa can be any naturally occurring amino acid
  misc_feature (226)..(226): Xaa can be any naturally occurring amino acid
  misc_feature (234)..(234): Xaa can be any naturally occurring amino acid
  misc_feature (358)..(358): Xaa can be any naturally occurring amino acid
MAEKITRETSLPKERSSPQALILGRYEMGKLLGHGTFAKVYLARNVKTNESVXIKVIDKEKVLKGGLIAHIKRGGAVLRRVRHPNIVQLFEVMATKAKIYFVMEYVRGGELFNKVAKGRLKEEVARKYFQQLISAVTFCHARGVYHRDLRPENLLLDENGNLKVSDFGISAVSDKIRQDGLFHTFCGTTAYVALEVLDREGYDDAKVDIWSCGVXILFVLMIGYLXVNDRGVLXLYRGLQGELGRRGENEATSFFELWRRIRETFTSPKLCRILVKKGLKHIKSNVEDDKLCNVVDDDELESDSVESDRDSAASESEIEYLEPRRRVGGLPRPASLNAFDIISFSQGFDLSGLFDDDXGEGSRSAPRAPVPKIISKLEEIAKVVSFTVRKKDCRVSLEGSRQGVKGPLTIAAEIFELTPSLVVVEVKKKGGDKTEYEDFCNNELKPKLQNLTADDVVAEPVAVSAVDETAIPNSPTISFLPSDTE

SEQ ID NO: 9225 - protein, 392 aa, Saruma henryi
PYEVPMTAAGALQSYKLAAKAISRLQSVPSGCLDRLIDTVVQEVYELTGYDRVMAYKFHEDDHGEVISEVTKPDLEPYLGLHYPATDIPQAARFLFMKNKVRMICDCRAKSVKVYQDEHLSFDLTLCGSTLRAPHSCHLQYMGNMSSIASLVMAVVINEGEEDDDGPDSTQQQAQPKRKRLWGLVVCHNTTPRFVPFPLRYACEFLMQVFAIHVNKELELENQIREKNILRTQTLLCDMLLRDAPLGIVTQSPNIMDLIKCDGAALLYENKVYRLGVTPTESQLHEIVQWLSEHHMDSTGLSTDSLHEAGYPKALSLGDIVCGMAAVRITTHDMLFWFRSHTAAEVKWGGAKHDPSDKDDGRRMHPRSSFKAFLEVVKTRSLPWKDYEMDAI

SEQ ID NO: 9226 - protein, 385 aa, Colwellia psychrerythraea
MKNSILFNAKKLGTFEASNRVVLAPMTRSRTAQPDDVPTDLMAEYYAQRASAGFIITEATQISSQGKGYSFTPGMFTPEQVTGWKKVTQAVHQADGHIVSQLWHVGRMSHASFHVDGLPVAPSAIAPDAQVWVVGEDGIGRMVDCPVPRELSKQDIKDIVLDYRLAASNAIEAGFDGIEIHGGNGYLIDQFLRRSSNKRNDEYGGSITNRLRFVMEVVEAVSDEIGANKVGIRLAPFITQRGMHDIEAIDAILLASKKFNDLGLAYIHLSEADWDDAPLVSDQFRQALRLNFNGSIVVAGNYTAKTGADLIDSGLVDFIAYGRKFLANPDLPYRFKHDLPLNDITDPSTLFGGDARGYTDYPRYSDQASVAQSNDSTKPTAEILP

SEQ ID NO: 9227 - protein, 391 aa, Saruma henryi
DLEPVNPDDVPVTAAGALKSYKLAAKAISRLQSLPSGNISLLCDVVVREVSDLTGYDRVMAYKFHEDEHGEVIAECKRSDLEPYHGLHFPASDIPQASRFLFMKNKVRMICDCSAPPVKVIQDKRLAQPISLGGSTLRAPHGCHAQYMANMGSIASLVLSVTISEDDDETCSKQKGRKLWGLVVCHHTSPRFIPFPLRYACEFLIQVFGIQLNKEVELAAQMRETHILRTQTMLCDMLLRDAPMTIVTQSPNVMDLVKCDGAALYYRKESWLLGVTPTKAQIQDLAEWLLKDHNGTTGLSTDSLVEAGYPRAHNLGDMVCGMAAVRITNQDFLFWFRSHTAKEVKWGGAKHDPADKDDDRGKMHPRSSFKAFLEVVKRRSLPWEDVEMDAI

SEQ ID NO: 9228 - protein, 374 aa, Streptomyces coelicolor
MFASVLVAGAASGSLPGTDRKSEPGTARSAAPAGQQARHDDVARAAAEAMADGKSPVEAAERAVSRSGDRWGAVYSEGEYEELEDALDGRYTGVGLSARRERDGRIEVTRVRSGSPAAGAGIREGDRLRSVDGERVDGRPVTEVVSILRGDGEREPAGTAVRLGLERGTRAWTETVRRARLSTDPVTVRTLADGLTVVKVTSFTKGVGEQVREAVARVPSGAGVVLDLRGNSGGLVTEAVTAASAFLDGGLVATYDVDGDQRALHAEAGGDTTRPLVALVDGGTMSAAELLTGALQDRGRAVVLGSRTFGKGSVQMPSRLPGGSVAELTVGHYRTPSGRGVDGTGITPDLEVDPADPGALARARTVLSGLGPTA

SEQ ID NO: 9229 - protein, 414 aa, Saururus cernuus
SGKPFYAIVHRVTGSLIIDFEPVKPFEVPMTAAGALQSYKLAAKAISRLQSLPSGSMERLVDTVVQEVFELTGYDRVMAYKFHEDDHGEVISEVTIPHLEPYIGLHYSATDIPQAARFLFMKNKVRMICDCHAKPVKVYQDDKLSFDLTLCGSTLRAPHSCHLQYMENMGSIASLVMAVVVNEGGDEDKGPDSSQQLGDNRRKRLWGLVVCHNTRPRFVPFPLRYACEFLTQVFAIHVSKELELERQIREKNILRTQTLLCDMLLRDAPMGIVNQSPNIMDLIKCDGAALFYKDKVFRLGNAPSETDIRDIAQWLFAHHMDSTGLSTDSLHDAGYPKAAFLGNLVCGMAAVKITCSDMLFWFRTHTAAEIRWGGAKHDHSERDDGKRMHPRSSFKAFLEVVKTRSLPWKDYEMD

SEQ ID NO: 9230 - protein, 391 aa, Saururus cernuus
DLEPVNPSDVPVTAAGALKSYKLAAKAISRLQSLPSGNISLLCDVLVREVSDLTGYDRVMAYKFHEDEHGEVVSECKRADLEPYLGLHYPATDIPQASRFLFMKNKVRMICDCLAQPVKVIQDKRLAQPLSLAGSTLRAPHGCHAQYMANMGSIASLVMSVMVSEGDDDSNEEKTGRKLWGLVVCHHTSPRFIPFPLRYACEFLIQVFAIQLSKEVELAAQMREKHILRMQTVLCDMLLRDAPMGIMTQSPNVMDLVKCDGAALYYRYQCCLLGTTPTENQIRDITEWLLQYHNSSTGLSTDSLVEAGYPGAHELSDAVCGMAAIRITSKDFLFWFRSHTAKEIKWGGEKHDPLDKDAFESKMNPRTSFKTFLEVVKRRSLPWEDVEMDAI

SEQ ID NO: 9231 - protein, 279 aa, Bacillus anthracis
MKNLQSTTKLHNGVEMPWFGLGVFKVEEGPELVEAIKSAIKTGYRSIDTAAIYGNEAAVGEGIRAGIEATGISREELFITSKVWNADQGYKETIAAYEESLKKLQLDYLDLYLVHWPVEGKYKDTWRALETLYKEKRVRAIGVSNFQIHHLQDVIQDAEIKPMINQVEYHPRLTQKELQAFCKEQGIQMEAWSPLMQGQLLDNETLQAIAEKHGKTTAQVILRWDLQNGVITIPKSTKEHRIIANADVFNFELTKEDMEKIDALNENHRVGPDPDNFDF

SEQ ID NO: 9232 - protein, 401 aa, Trochodendron aralioides
GKPFYAIVHRVTGSLIIDFEPVKPYEVPMTAAGALQSYKLAAKAIARLQSLPSGSIERLCDTLVQELFELTGYDRAMVYKFHEDDHGEVVSEITKPGLEPYLGLHYPATDIPQAARFLFMKNKVRMICDCRAKNVKVLQDEKLPFDLTLCGSTLRAPHSCHLQYMENMNSIASLVMAVVVQEGDEQARALVPHSLRRRKRLWGLLVCHHSTPRFVPFPLRYACEFLAQVFAIHVNKELELENQILEKNILRTQTLLCDMLMRDAPLGIVSQSPNIMDLVKCDGAVLLYKNRTWRFGSTPSELQIHDIALWLSEYHMDSTGLSTDSLYDAGFPGALTLGDGVCGMAAVRITSKDMLFWFRSHTAAEVRWGGAKHEPGEKDDGRRMHPRSSFKAFLEVVKSRS

SEQ ID NO: 9233 - protein, 390 aa, Trochodendron aralioides
DLEPVNPADVPVTAAGALKSYTLAAKAISRLQSLPSGNLSLLCDVLVREVSELTGYDRVMVYKFHEHKHGEVVAECRISDLEPYLGLHYPATDIPQASRFLFMKNKIRTICDCLAPPVKVIQDKRLVQPLSLCGSTLRAPHGCHAQYMENMGSIASLVMSVMNHEDEDEIESDRKGRKLWGLVVCHHTSPRFVPFLLRYACEFLIQVFGIQLNKEVELAAQLREKHILRTQTVLCDMLLRDAPVGIVTQSPNVMDLVKCDGAALYYRNTIWLLGVTPTEAQIRDIAGWLLEYHNGSTGLSTDSLMEAGYSDALLLGDAVCGMAAVKITSKDFLFWFRSHTAKEIKWGGVKHDPVDKDDGRKMHPRSSFKAFLEVVKRRSLPWEDVEMDAI

SEQ ID NO: 9234 - protein, 225 aa, Bacillus subtilis
MNLTYKVHPIKTRYQGWTNYCYIIEDIVSRSAIVVDPSWELSKITTTLSELEAELKAVALTHSHYDHVNLVDPLTKMFNAQVYMSKKEIDYYQFRCRNLISLDDHQTISIGNTRAQCLLTPGHTAGGMCYLFSESIFTGDTVFTEGCGICEDDGSSAEEMFDSIQRIKSEVSPHVRVYPGHSFGKSPGHSIKDLYQHNIYFQIDKKEYFVKFRTRKNQKGIFDFK

SEQ ID NO: 9235 - protein, 740 aa, Methylococcus capsulatus
MTDSSTLAELSPDFQRIVEARHHDPFAVLGRHRRDNRDLIRAFLPQAEEVRVGSAGRVMERIAGTAIFECEVEAETTDLHYRLYWTDQTGQTHSFIDPYTFPPRLSDFDLYLFGEGRHWNIYRVLGAHPHSVDGIDGILFATWAPNAERISVVGEFNGWDGRRHPMRVRGASGVWELFIPELQPGLLYKFEIRNRAHGTIHLKSDPYGRQFELRPNTASIITRESGYAWNDADWLAQRKDWPWLHRPLSVYEMHAGSWKRDLEGGYLNYRDLAHELVDYVKSAGFSHIELMPVTEHPLDASWGYQTTGYFAPTSRFGTPDDFRYFVDHCHRNGIGVILDWVPAHFPKDAHGLARFDGTALYEHEDPRLGEHRDWGTLIYNYGRNEVKNFLLGSALFWLEEFHLDGLRVDAVASMLYLDYSRQPGDWIPNKYGGNENLEAIAFLRDLNTVVHQQFPGVLVIAEESTAWPQVTRPTWTGGLGFSMKWNMGWMHDILVYMGKDPVHRHYHHDQLTFGLLYAFTENFVLPFSHDEVVHGKGSMLAKMPGDEWRRFANLRVLYTMMFTYPGKKLLFMGCEFAQTGEWNHTTALDWPLLESNLHKGVLHLVSDLNRLYQSTSALYAYDFESQGFEWIDSHDAAQSVISYVRRDDDSHVVVVLNFTPVPRHNYRIGVPEPVGYREVFNSDAECYGGANLGNWEIKTESVEWMGRAQSVVLTLPPLAGIVLAPVAPSATPDCGTPGDE

SEQ ID NO: 9236 - protein, 245 aa, Phalaenopsis amabilis
MGRGRVQLKRIENKINQQVTFSKRRSGLLKKAHEISVLCDADVALIIFSNKGKLCEYSTDSSMEKILERYEHYSYTERALYSNEDNPQADWRLEYNKMKAKVESLQKSQRHLMGEQLDYLSIKELQHLEQQLESSLKHIRSRKTQLMVDSISELQKKEKLLLEQNKTLQDMAKAKAKALVQNAAWEQQNKSQYSSEPPHAVISDSVPTPTSRTFQTRANGEESPQPQLRLGNSLLPPWMLSHVNG

SEQ ID NO: 9237 - protein, 250 aa, Phalaenopsis amabilis
MGRGKVQLKRIENKINRQVTFSKRRSGLLKKAHEISVPCDAEVALVIFSAKGKLYGYSTDSCMDRILDRYERYCYAEKALQITEPESQGDICNEYGKLKNKIEALQKSRSHLMGEQLDSLSIKELQHLEQQLETALNHIRTQRIQLLLNCITEFQRKEKSLLEHNSLLEAKLCSFQLDPQITETATQNPNRKQQKQDQVNSSPSPFLPPNHLPTLNLGTYPASDGEEAEDPTLLQMNSISLPPWMLRSST

SEQ ID NO: 9238 - protein, 460 aa, Zea mays
  misc_feature (307)..(307): Xaa can be any naturally occurring amino acid
MVNGERRADAECTRASLLGRYEIGRTLGEGNFGKVKYARHIASGGHFAIKILDRSKILSLRIDDQIRREIGTLKLLKHPNVVRLHEVAASKTKIYMVLEFVNGGELFDKIAIKGKLSEHEGRRLFQQLIDGVSYCHDRGVYHRDLKPENVLVDRKGTIKISDFGLSALPQHLGSDGLLHTTCGSPNYIAPEVLQNRGYDGSLSDLWSCGVILYVMLVGCLPFDDRNLVVLYQKIFKGDCQIPKWLSPAAQDLLKRILQPNPMKRINVAGIREHEWFKKDYVPAVPHDDDEDVLPSPAPSIKPIDEPXQEKCSPINAFQLIGMASSLDLSGFFEEEDAAQRKIRFTSTHPPKDLFDKIESVVMEMGFKVHRGAGKLKVLRNSKCSRNPSSLLVCTEVFELGPSLYVVELRKSHGDSTLYRQLCERLSDELGACKTDQIARTESSSDDLSSVDGEAFPLSGF

SEQ ID NO: 9239 - protein, 770 aa, Magnaporthe grisea
MAPRNVLIYLFRKDLRVSDNPILHGLATQKDHGFTHLLPVYIFPANHIEISGFISDQSEKSPYPEARSKVAGYWRCGPYRAKFISQAVWDVKNSLESINSGLLLRLGSFQDVLEGLLDGLKARGDTCSVWMVGEEGLEEIQDEISISNVCRTRGYDFEKLVDEKYFIDDRDLNFAEPQELPGIFTDYRKSVEPLRERPRKSLPTPEKDSLPPFPEPDTIAEQSRPFSIPDTYEGFETALLKPVKDFSGAPFPEHAENATTAHPFKGGETAGQERLQYVMSSGIIKDYKTSRNGLIGPDFSTKLSAYLAQGCITARQIHESLLAYEDGSAAELEEIEGYGQGENINTKSVREELMWRDYMRLYARKIKEKLYSVEGPRGGRNYDSSNSGEVVDSGSPPIAKKVIWKTPDPATADPRQIPEPEKIKVCLDRFLAGTTGLGLIDASMRELMHTGYTSNRARQNAANFLAKHLGIDWRWGAEWYEMLLVDYDVCSNWANWQYVAGVGNDPRGEARIFNPVKQAFDYDKEGAYVKMWVPELAPFGNKLELVFQACKATPQERDEAGLSDNIMVTDPVKRISFNPNGKPPSKRPWKKKDSGSGNTAGGGGGSPKEGSPRTETHSGGQGKGDGGSHQSRGGRPQWRGAQGYSPQMGRAPPGNGPGYRSYHHGAYGGPGPQGGRGGWQRRAGGPVRGGGLQSFGYRNPYYAGRGGYPQQPYEGGPPNYVPVQGGGQHGPMSHYGPGGGGSTQSQQAWTPPNQRQQPQQQQQQQQQSNA

SEQ ID NO: 9240 - protein, 1142 aa, Unknown
  Bacillus sp. KSM-1876
MKGKLKKFLVLSMVFILTFSSFGMMGTTQLVEAETKSSIEESEIPENTLRIHYQNSSGDYSNLGVWTWDDVESPTDNWPSGGIPFTEEQVTDYGAYVDVPLESGARNVGFLILDIVTGGKDDAGHNGGDKRLELFSPNINEVWISEGSDEISFIEPVDLPEDTVRVHYKKADGNYENWSLWFWGDVQSPSETQGDFPSGATGFSEEQIGKYGAYIDIPLNEGAEEIGLVVVNKETNEQEADRSFTQLNQFNQIFIVEGDGAVYSNPYGAIATELLSAEQLSDEKIVLYFSRTDELTEEALLEQVGIRDIEEHTVDVNEVEIKTDNRTVEVKGDFNLDQSPYTVSLGEVSVPAKIGWRLIDEMYAYDGELGAQLHQDGTATIKLWSPKAEHVQVILYDKDNPDDIVTEVEMKLGDRGVWEVQLTKENTGLDSLRGYYYHYEIDHDGDKKIALDPYAKSLSAWNSDEQGPYAKAAIVDPSSIGPELEFAHIEGFEKKEDTIIYEVHVRDFTSDPHIADELTAQFGTFASFVDKLDYIEDLGVTHIQLLPVMSYFFANEFKNDERMLDFSSTNTNYNWGYDPQSYFALTGMYSEDPTDPELRIKEFKKLIDEIHSRGMGVVLDVVYNHTARVGIFEDLVPNYYHFMDADGTPRTSFGGGRLGTTHEMSRRILVDSITYWVEEFKIDGFRFDMMGDHDAESIQIAYDKAKEINPNIVMIGEGWITYAGDEDDPNVQAADQHWMQYTESVGVFSDEFRNELKSGFGHEGEPRFLTGGARNIDLIFDNIKAQPHNFIADDPGDVVPYIEAHDNLTLHDVIAMAIQKDPDDHQEEIHQRIRLGNLMTLTSQGIAFLHAGQEYGRTKQFRAETSEPPYKSTYMTDENGEPFRYPYFIHDSYDSTDIINRFDWERATNADAYPIQNLTREYTTGLIELRRSSDAFRLGTKDLVDEKVTQLNIPEIEETDLVVAYRIEATTGEAFYVFVNADDEERTLTLEEDLTVGEFVVDGKTAGVTAIAEPQGVELSAEQIKLDPLTAAIVQVGGIEAPEKPTPPKEEPKEPKEPKEPKEPKEPKDPKDPKDPKDPLDPPGTDDQNGETPKGNEEKKEEQKGDNLPNTATSNYQFIALGIALVLMATAIYWWKRKRQVA

SEQ ID NO: 9241 - protein, 105 aa, Glycine max
FAIERQAVNEATFRCPDEMGWKPQTTLLPVEEITKALANKGYDVMTSDDAGRFVCNYVYYHSLRFAEQNGTKSLFVHVPLFSTINEETQMQFAASLLEVLASTCQ

SEQ ID NO: 9242 - protein, 258 aa, Thermobifida fusca
MAVPTVTLNNGVTMPQLGFGTWQVGYDAVAAALAAGYRCFDTAEMYRNETAVAAALADSGLDRSDVFITTKLWNNHHGFQPALDAFHASRRRLGLDVIDLYLIHWPNASDAVNVETWRALEQLYAEGVVRAIGVSNFSPAQLAVLLEACDVVPAVNQIELNPSRPRLEERVYHARHGIATQAWAPLAKGGALLTHPVITEIAEAHQKTPAQVVLRWHLQHGILVIPRSATPERIRSNFAVTDFSLAPQEMAAVDALGA

SEQ ID NO: 9243 - protein, 440 aa, Methanococcus voltae
MRNNIVNKGTEELSYEIRGIVAVAERAQKLGKKIIWENIGDPIAKGEQMPEWIKEIVSESTLENKTYGYCPTQGLLETREFLADLNNSKNGAQITSDDMIFFNGLGDAITNIYGLMRKECRVIGPTPAYSTHSSAEGLYSNSSPVMYSLDKDNLWYPDLDDLENKVKYNPSVSGILLINPGNPTGAVYSKKVLSDIVDIANEYDVFILCDEIYQNLVYNGKKHVSLSEVIDDVCGISMKGISKDLPWPGSRCGWTEFYNKDKDPVFKKYVENIGKFKMIEVCSTTLPQTIIPKVMGDKRFEKSLGERKKYYEKASNYAYKTINKVEGVSVNLTNGAFYGALTFDDGVLNDKQHLKMDNELDTYINGVLDQCGQHSLVEKDKRFVYQLLGASGICMVPLTSFCSKHEGLRFTLLEKDENLMKWTFKTLSEKIDEYLNSSAN

SEQ ID NO: 9244 - protein, 463 aa, Listeria monocytogenes
MNNNFLWGGATASYQCEGAWDVDGKAESMWDYYLHEAGLENGDVASDHYHRYEEDIRMMKEGGQNSYRFSLSWPRIIKNRQGDINLKGIEFYQNLLDTCKKYDIEPFVTLYHWDLPQYWEETGGWLDHDVCAAFEHYAKVCYDHFGDKITNWTTFNEPKWFVANGYKIGNYPPGYQDTHKTMIAAYNVMYASALGVKAFKEGGYPGQIGIVHSYTPVNGVDESIETKIAMRYADNYCNNWILDTAALGEFPVDLIAELAKSHDISFMKTDELQTIKQNTVDFIGLNYYSRTLVKPYTGGETQLQFNHSGKKGESKVLIKNWFEQVKDPANETTEWDTEIYPKGLQDGLIEAYERYQLPLYVTENGIGVREDVSVPQVDDAYRIAFMNDHINAIFNAIDAGCDVRGYYAWSPFDLYSWKNGVEKRYGLVAVDFENNQIRKPKASYYWFKEMIKSQGKLIKRREF

SEQ ID NO: 9245 - protein, 310 aa, Neurospora crassa
MADHTEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKYVPSLR

SEQ ID NO: 9246 - protein, 471 aa, Vibrio vulnificus
MAMKLVWLRRDLRCVDNTALNHAIATSQEVVACFVATPLQWRDHHMAPMQADLIARRLAVLAEELNALNIPLLYDEVDDYAQSATRVANWAEQLAVSEVVLNREYEVNERVRDEQLVNRLASSEMGVLDVEDKCVQAPGCVLNKQGDYFKVFTPFKKAWLKSFIPPQIIKTSAAQPVVLPEALQSSLWHEQAPFSYPRQSSEAWSVDSQQIRETLRRFCHEEVDRYHEQRDFPATAGTSVLSPYLAIGAISVRQCIARLYWQQSYLSNGREVWLSELIWREFYHHLIHFEPKLVKGQGFVEWEKHLLWPAKPDWFERWCRGETGYPIVDAAMRQLNQTGWMHNRLRMIVASFLTKDLHVNWRLGEQYFMQKLVDGDFAANNGGWQWCASTGCDGQPYFRIFNPITQGEKFDPNGEFVKHWLPELAEVPSKFVHQPWKWLGHMRLDYPAPMVDHKQEREITLSLYTQAKDCL

SEQ ID NO: 9247 - protein, 384 aa, Oryza sativa
MAFDAFTDKNAVFRRLKAKPENKMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEAPAENTNGKQEPDVTNSQKAPTQTPKAPTHPTFATSVKKSIGAKKIGGKTGGLGVKKLTTKPSESLYDQKPEEPKPAAPVMTTSTTKSGPSLHSRFEYVENEPAVDSRNGGTQMTGHVAPPKSSNFFQEYGMDNGFQKKTSTAATKTQIQETDEARKKFSNAKAISSSQFFGNQSREEKDAQMSLQKFAVRISLASLCPRTITLHLLRTCRSILNFIPDLKFLVYCLCLC

SEQ ID NO: 9248 - protein, 178 aa, Glycine max
IRLEGGYMEVTGFSAEVREQIYKVASVNLCSNISGQILASLVMSPPKVGDESYDSFMAEKENILASLARRAKTLEDAFNKLEGVTCNKAEGAMYLFPQIRLSEKAIKAAEAANATPDNFYCKRLLNATGVVVVPGSGFGQVPGTWHFRCTILPPEEKIPAIVTRLTEFHEKFMDEFRD

SEQ ID NO: 9249 - protein, 605 aa, Methylococcus capsulatus
MCGIAGLVLKGRNVQADRLHPMIERLAHRGPDGQGVFTEGGFGLAHTRLSIIDLSGGRQPILADDGRLAVVANGEIYNHVELREALEREGRRFATHSDSETILHAYALDPEGFAGRLHGMFAFALYDGVRRRLVLGRDRLGIKPLFYAALPDRLVFASEMKAILPLLPNAPTIDAGAFSQFLHTHCSTGEETLFSGIRRLGPGEILEADAELNLRKRRYWTPLGVRSRALDFAEAEAEFEGMFEQVMKEHVRSDVPYGLFLSGGNDSAILLAMLSRLQAQPVRTFSIGYVDAAMKDELGDAERIAQVFGSRHTSIRLRREDLFRRIPHTVWAADDLMRDYASFPTSALSEAAAKELKVVFTGEGGDEVFGGYRRYRQPRLAWLARNLLAPGTGGFRTRSEWWRKRSQRLFGPALAAERKHFRAPYLKAWSEAPAVWSHLQHCQYTDLVTDLPDSLLVKVDRMMMGFGLEGRVPFLDHRVVEFGLGLPDALKTDGKRPKVFLRRWAERHVPKEHLYTKKRGFTVPVREWLGGELLDRLEGKLSGNAAVREWFDTRHFPALFQAQRKKGNASREIFCLMQFAIWHRLFIDQPGLKPSPDEDPLDWIS

SEQ ID NO: 9250 - protein, 548 aa, Colwellia psychrerythraea
MAAKDVLFGNDARTKMLRGVNVLADAVKVTLGPKGRNVVIDKSFGGPTITKDGVTVAKEIELDDKFENMGAQMVKEVASKANDEAGDGTTTATVLAQAIVNEGLKSIAAGMNPMDLKRGIDKAVIAAVAALKDASTPVTDNKAIEQVGTISANSDETVGQIIATAMDKVGAEGVITVEEGQALTDELDVVEGMQFDRGYLSPYFINKQENGTVELENPFILLVDKKVSNIRELLTTLEAVAKSGKPLLIIAEDVEGEALATLVVNNMRGIVKVAAVKAPGFGDRRKAMLQDVATLTAGTVISEEIGMELEKATLEDLGQAKRVVISKDTTIIIDGIGEEADIKARVSQIRGQIEDSSSDYDKEKLQERLAKLAGGVAVIKIGAATEIEMKEKKARVEDALHATRAAVEEGVVAGGGVALVRAAEAIKDLEGINEDQTHGINVAIRAMEAPLRQIVANCGDEASVVLNEVRNGEGNYGYNAGNSTYGDMIAMGILDPTKVTRSALQFAASVAGLMLTTEAMITDAPQDSAPAMPDMGGMGGMGGMGGMM

SEQ ID NO: 9251 - protein, 445 aa, Arabidopsis thaliana
MASNGVTNCNANANVWRFKGNGATSDAAAVTLRKLAFGMFKNCTMNSGKTILFPTPGEPSAHSNFRTCPEAEEAVADAARSGMANSYAPSPGVFKARRAVAEYLNGELPTKLKAEDVYITGGCNQAIEIVIDSLAGNPSANILLPRPGYPHYDARAVYSGLEIRKYDLLPESDWEINLDGLEAAADENTVAMVIINPNNPCGNVYTYDHLNKVAEMARKLGIMIISDEVYDHVVYGDKPFIPMGKFASIAPVITLGSISKGWVNPGWRVGWIAMNDPNGIFVSTGVVQAIEDFLDLTPQPSFILQEALPDILEKTPKEFFEKKIKAMRRNVELSCERLKDIPCLFCPKKPESCSYLWLKLDTSMLNNIKNDFDFCTKLVSEESLILIPGVALGAENWVRISIGTDESVVQEIFDRLKGFYDRHAISKEAIKLSGHAINQIVVSVN

SEQ ID NO: 9252 - protein, 661 aa, Geobacter metallireducens
MNLETWRIRNWRLFTKIFLMSTVAVFVIIAGLLGFFLPLLESKLIHERTDNASHIVDAARSIAAHYHSLQLRGELSEPEARRLAVNTLRALRYNVNGYVWVHDLENRMVMHPLQPELEGHYLTRLADARGKPLFLTMNNLVRREGKGEVDYLWPRPGEQEPSRKVSYVSLFEPWQWVLGSGVYLDDVQDEISMLEARVITGALVTLLLSVVFSAYAAYRINRPLRQALFCAAAAMGHDTSVVEDKSHDETHQVLHTIERMVNDLKRSRDEAESASRMKGEFLANMSHEIRTPMNAIIGMTELTLETPLSPSQRENLEIIGSSAESLLGLLNDILDFSRIEAGRLLLEKVPFDLRNTVEGALDVVAPQAHGKGLELILDVARDLPEAFIGDPTRLRQVLINLLSNAVKFTAKGEVGLKVERAPSSGTDDGVMLLFTVSDTGIGIPADKLSLIFESFTQADGSTTRKYGGSGLGLAICRALVSMMGGDISVKSAVGVGSTFRFTARLGTCALQNREIRQAGIPRFGREVKILLAEDNPMNLKVSRLLLEMMGCQVVAVENGGDVVSAMKGERFDVVLMDIQMPVLDGLEATRVIRSGSERGIDQTTPVIAMTAHALKGYEKVCHEAGMNDFISKPVRAGELYNVILRNLPPAPGGGGVTPSAL

SEQ ID NO: 9253 - protein, 119 aa, Zea mays
  misc_feature (21)..(21): Xaa can be any naturally occurring amino acid
  misc_feature (87)..(87): Xaa can be any naturally occurring amino acid
IYPSQATLIINALEKRNHNLXYILNTHHHYDHTGGNLELKEKYGAKVNCSEKDKDRIRGIDIILKEGDTWMFAGHSVHVLETPRHTXGHGCYYFAGCGAILTGDTLFNLSCRKLFQWSP

SEQ ID NO: 9254 - protein, 539 aa, Spinacia oleracea
MEVISRLTFASVSYPFISSNLNPTPMLNSFNFRVLSWNSAPTNVAEAHLHRLLLRKLNPANDRVVGISNFGCSCRLDLWPSWRRHKRLFFQNGVSTIRWEVKKCSPKFYKIVSNYEKCKRHIYVPSVRLVVGVVLLMSVSVALNQDPSWSLSEENRIFLEAWRTIDRAYVDKTFNGQSWFRYRENALRNEPMNSREETYTAIRKMVATLNDPFTRFLEPEKLKSLRSGTQSSLTGVGISIGPTAVDQSSTGLVVISATPGAPASRAGILPGDVILAIDDASTDKMGIYEAANILQGPDGSSVDLTICSRDEIKHVVLKRERITLSPVKSRLCEMPGSAKDAPPKVGYIKLTTFTENASDAVKEAIETLRSNNVNAFVLDLRDNSGGLFPEGIEIAKIWLNKGVIVYICDSRGVRDIYDVEGSSAVAGSEPLVVLVNKGTASASEILAGALKDKKRAVVFGEPTYGKGKIQSVFELSDGSGLAVTVARYETPAHTDIGKVGIKPDHPLPASFPKDENDFCTCVQDPSSTCYLNGVQLFSR

SEQ ID NO: 9255 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFQPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 9256 - protein, 155 aa, Unknown
  Petunia x hybrida
TLINRAGKATYVKFHWKPTCGVKSLLEEEAARVGGENHSHATQDLYDSIAAGNYPEWKLFIQTMDPAHEDSFDFDPLDVTKTWPEDILPLQPVGRLVLNKNIDNFFNENEQLAFCPSIVVPGVYYSDDKMLQTRIFSYSDTQRYRLGPNYLQLPA

SEQ ID NO: 9257 - protein, 540 aa, Rhodothermus marinus
MAAKQITFNADARMALKRGVDKLADAVKVTLGPKGRNVIIEKKFGAPTVTKDGVTVAKEIELEDKLENVGAQMVKEVASKTSDVAGDGTTTATVLAQAILTAGLKSVTAGANPMDLKRGIDKAVEVVVAELRKMSQEVQDKNRIAQVATISANGDKAIGQLIADAFEKVGKDGVITVEEAKGTETTLEVVEGMQFDRGYLSPYFVTNPDTMEAVLEDAYILIHDKKISAMKDLLPILEKVVQTGRPLLIIAEDVEGEALATLVVNKLRGVLKVAAVKAPGFGDRRKAMLEDIAILTGGTVISEEKGYRLENATLDYLGQAERIIVDKDNTTIVGGKGDPAQIKARANQIRQQIEETTSDYDREKLQERLAKLAGGVAVLKIGAATEPEMKEKKARVEDALHATRAAVEEGIVPGGGVAYIRAIAALDKVEVENEDQKIGVQIVQRALEEPLRQIAANAGWEGSIVVQRVKEGQGDFGFNAQTEEFGNLLEQGVIDPTKVARTALENAASVAGLLLTTEAVVAEKPEKEKAAAPSPGDMDF

SEQ ID NO: 9258 - protein, 305 aa, Arabidopsis thaliana
MSLSASEKEENNKKMAADKAEMGRKKRAMWERKWKRLDIVKAFASLFVHFLCLLAPFNFTWPALRVALIVYTVGGLGITVSYHRNLAHRSFKVPKWLEYFFAYCGLLAIQGDPIDWVSTHRYHHQFTDSDRDPHSPNEGFWFSHLLWLFDTGYLVEKCGRRTNVEDLKRQWYYKFLQRTVLYHILTFGFLLYYFGGLSFLTWGMGIGVAMEHHVTCLINSLCHVWGSRTWKTNDTSRNVWWLSVFSFGESWHNNHHAFESSARQGLEWWQIDISWYIVRFLEIIGLATDVKLPSESQRRRMAMVR

SEQ ID NO: 9259 - protein, 299 aa, Arabidopsis thaliana
MGDTTKDDGSSQSKAVRGEKRAFFFRKWTRIDIARASAVGAVHLLCLLAPFNYKWEALRFGVILAIVTSLSITFSYHRNLTHKSFKLPKWLEYPFAYSALFALQGHPIDWVSTHRFHHQFTDSDRDPHSPIEGFWFSHVFWIFDTSYIREKCGGRDNVMDLKQQWFYRFLRNTIGLHILTFWTLVYLWGGLPYLTCGVGVGGTIGYNGTWLINSACHIWGSRAWNTKDTSRNIWWLGPFTMGESWHNNHHAFEASARHGLEWYQVDLTWYLICFFQALGLATDVKLPTDAQKRKLAFAR

SEQ ID NO: 9260 - protein, 583 aa, Magnaporthe grisea
MCGIFACHAHPDVQKFKPTALRLAKAIRHRGPDWSGSVTCNQTILCHERLSIVGVESGAQPLTNEDESIILAVNGEIYNHRLVRKSLKTPYHFKTTSDCEVIIPLYMEHGLDAPKYLDGMFSFVLYDKKQNRTIAARDPIGVTTFYQGWSSSEPGAVYFGSELKCLYQVCDKIEAFPPGHIYDSLTGERTRYFQPTWWDPKRVPETPLDLTKLREALEKSVRKRLMAEVPYGVLLSGGLDSSLVASIAQRETKRLKKLAIEAGLEDLPAEPTGNHDQGEGLVGIDDENKLSTMTYLPQLNSFSIGLPGSPDNKAALEVAKFLGTKHHVMTFTIEDGLNALSDVIYHLESYDVTTIRASTPMYLLSRKIKAMGIKMVLSGEGSDEAFGGYLYFHNAPDKDAFHDETVRRVKNLHLSDCLRANKSTSAWGLEARVPFLDKEFLELAMNIDPKEKMITKERIEKYIVRKAFDTSDDPNAEPYLPDNILWRQKEQFSDGVGYGWIDALKDNAEIQVTDEMMKNPKPEWGDDIPDTKEAYWYRCMFDEHFPPHCASTVERWTPTWSKQTDPSGRAIAVHAAKYDHISE

SEQ ID NO: 9261 - protein, 469 aa, Streptococcus pneumoniae
MKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWLERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 9262 - protein, 1209 aa, Xylella fastidiosa
MRCLKRVRGGLLTALLVFVSLLTATAAVPEMPRFRVLDATSGLPSNVVRAMLQDAAGYLWLATSDGLARYDGTAFKVWRHDPNDPGSLPGDSVLALYIDVQDRIWVLSENAGLAVLDAQRRRFIQIPVGSVAKTDALHTLTGHGDAIWLSDLHASVIRIDSAGALTRYALADVSPTLKDTPVVALTFDANGRLWVGTPDGLLYFEAGRLHLAPPPLDKASIHSIAAVGSRLWVGSTDGVYLQDAEGRWRAPNWGPMFAFGNLLLSVADAGDGEFWLGSERGLWRTRQERPPVQIPLSDMHHGVSTVSSLWRDTSGGLWVPVYGRGLGYLRQDWKRMAVVRPSDGGESSYCNVAPAAYSGGLWQLNRIGELMHLNTSTGELVHTGWQRHELRGVNITTTLEDSRGRLWLANMQNGLSRLDLKNGQWREWAAHGDDAVPLYGPISWIVEMPDSSLWLEALGVLQQRDLESGRVLNQIVPGSHGLDGSRVEQIGLGPDGRLWLAAGSGVYAWESQRRMFVPIPDLTGTRAYSFVPVGGNEVWVHRLRGLEQWRHSSHGWKRVALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGRRIDFPVDRPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVSWNYHRRLRRRARLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVVDTGPGLSEEQCQRLFRRFEQVNGASTAARYGGSGLGLAICRELATVMEGEIHVDSELGKGTCFRVLLPLPWVLAVQPAVAVMDMEPSPCSNPLHLLLIEDDPTVAEVIVELLRVRGHRVTHALHGLEALVEVTLTRFDACLCDLDLPGLDGAGLIVQLRAQGQSFPIVVVTARTDADAQRQAFQVGCDAFLRKPVTGEMLEQVLTQVLSAPRQEVDVHTPKKRNGMGRPRISDSIKRDLG

SEQ ID NO: 9263 - protein, 238 aa, Arabidopsis thaliana
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 9264 - protein, 346 aa, Bacillus cereus
MMNSKLFSPYTIKNVTLKNRIVMSPMCMYSSGNEDGRVTNFHLIHYGTRAAGQVGLVMVEATAVLAEGRISNNDLGIWDDNLIEGLHKTTTFIHDNGAKAAIQLAHAGRKAELDTNAFAPSAIPFNDKMKIPVEMNIQQIKETILAFQRAALRSKQAGFDVIELHGAHGYLINEFLSPLTNKRTDKYGGSPENRYRFLREIIDSVNEVWDGPIFVRISANDYHPDGLTVQDYVQYTKWMKEQGIDLIDCSSGAVVPAHIDVYPGYQVQYAKHIKEHTNIATGAVGLITTGSQAEQILNNNEADLIFIGRELLRNPYFPRIAANELGFELQEPHQYKRAPGKIHTNK

SEQ ID NO: 9265 - protein, 540 aa, Triticum aestivum
  misc_feature (106)..(106): Xaa can be any naturally occurring amino acid
  misc_feature (234)..(234): Xaa can be any naturally occurring amino acid
MEAAAELAQRLRAAANDRLAGQEPLLLVAAPLLALLAARAVHAAAADVADRGLRTVLITLAMAAVKLVPGVSGYIAAEKSKVVEQLQSGSASSKKNLRTELPAVGXPDGVIDELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEIIIAESAXHSAYDKAAQYFNIKVRRVPVNKEFLADVKGFKRCINGNTIMMVGSAPGFPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYISPTMAGSRPGGLVAGAWAAMMSLGLNGYLESTGKIMEVSRKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 9266 - protein, 471 aa, Listeria monocytogenes
MHTNTGFPANFLWGGAAAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYENYVRTVFNRYKGKVKYWLTFNEINSILHAPFMSGGISTSPDKLSQKDLYQAVHHELVASALATKIGHEIMPEAQIGCMVLAMPTYPLTSNPDDIIAVMEAERKNYFFSDVHVRGTYPGYMKRYFRENNIELDVTEEDLEILKNTVDFISFSYYMSTTETADESKRKAGAGNILGGVQNPYLEASEWGWQIDPQGLRVVLNEFWDRYQKPLFIVENGLGAIDQLEKDENGNYTVNDDYRINYLSAHLSQVKEAIKDGVDLMGYTSWGCIDLVSASTAEMKKRYGFIYVDRNNDGTGTLNRYKKKSFGWYKNVIATNGEDL

SEQ ID NO: 9267 - protein, 279 aa, Caulobacter crescentus
MSKLVPAVRSGDVLMPALGFGTWQLENGTAVPLVEKALEIGYRHIDTAQIYGNERDVGAAIRNSGVKRDEIFLTTKVWIDQFADGDLQRSAEKSLEKLGVDQVDLLLLHWPKPEVPLAETLKALNAVRAKGWTRAIGLSNFPSAQLEEAAKLSEAPIATDQVEYHPYLSLKTLKAKADQLGVSITAWSPLAQGKVAQDPVLIEIGRAHGKTPGQVTLRWIIQQGIIAIPRTSNPKRIEENFDILDFELSEKEMAQIHGLARPDGRIGDWIDRAYAWDAE

SEQ ID NO: 9268 - protein, 708 aa, Alkalilimnicola ehrlichei
MHWTESMKRQVIRPALVIAGILLALVLVISGNDGPGRPAPAVAHSELAPDSEQREKASVIADLLTRYHYRGQPLDAGLSERVFDAWLDQLDRERFYLLQEDIDAFDEHRIGLHEQLRHGDLSVPFALYERYRERVAERTEYAIGLLEAGLDFDTDLRFEQDRRDADWAESREALDRLWRKRVTHDALTQKLAGRDEEQVIQTLTQRYERIRRTTEQESGEDVFQRYMDAWAHAFDPHSSYLSPRRSEDFDINMSLSLEGIGAMLQSEHDFVTIVELVPGGPAAQSEALSPGDRIIGVAEGEDGEMKDVVGWRLSDVVDLIRGPRGSVVCLLVLPEAGSGNATPREVVLERNEIKLEDQAASAEVIEVPGEGSGKDRIGVITIPAFYMDFEAAEAGDPDYRSTTRDVRRLLNELKEGGIDGLVLDLRGNSGGSLREAASLSGLFMGGGPIVQVRRSSGELEVLRGGDRANSAPLYDGPLGVMVDGFSASASEILAGAIQDYGRGVIMGKDTFGKGTVQTMINLDRFGLGNGEDGAGRLKLTVAKFYRVTGDSTQKKGVQPDIILPSPIDASEFGERGIDNALPWNQISAVDYRRDDTLEELIPALRSRYQTRAEDDPQFQALLRDFEYQLQRRERTDVSLNETTRKQERDAEEQERLALHNARREAAGLEPLEDAESRDDDELPDVLLEAAASVIADLRRLQAAYMAQR

SEQ ID NO: 9269 - protein, 498 aa, Magnetospirillum magnetotacticum
MCGIAATIGLSDATAFTSLFGAIGHRGPDESGIRESGDIRIGMHRLAIVGRMGDSVPLIGADGLVLAFNGEIYNHQALRADFPDYPFAGQSDAEVLFPLLKRHGLGGLDRLRGMFAFVLTDMESGEFLAVRDPFGIKPLYYAETGGGFAFASEMKAFAAMGITPRFLPPGHLLTRHGLRRWYRVPGRFRLSRRPNLRALLERAVASHLPPEGPCGVFLSGGLDSSLVAALAARSRPDMVAYSVVLPGSPDEEPAALMAAHLGIRHKVLRATADDIRAALPEVIGALESFNPIMVRNAVPLYLLSKMAAKDCKVVLGGDGADELFAGYDYLSRVPRRFWPQAMDYGFSNLHRTELQRVDRMTMAHGLELRVPFLDREVAEAAVNLPLSAKFGIKDGTPMPKLALREAAEGLLPPSIQWRRKLPLADGSGFGGLDLGAGRDKADPVPGWDVGDEDAVAFFPLWRVRFPLARPDSAIWRDCGRYHDFEECHGRPLLELFRR

SEQ ID NO: 9270 - protein, 472 aa, Escherichia coli
MTTHLVWFRQDLRLHDNLALAAACRNSSARLLALYIATPRQWAAHNMSPRQAELINAQLNGLQIALAEKGIPLLFREVDDFAASVEIVKQVCAENSVTHLFYNYQYEVNERARDVQVERTLRNVVCEGFDDSVILPPGAVMTGNHEMYKVFTPFKNAWLKRLREGMPECVAAPKVRSSGSIKPAPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLMTYYPSLCKHCPFIAWTDRVQWQSNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRQWLPELRNVPGKSVHEPWKWAEKAGVKLDYPQPIVEHKEARVQTLAAYEAARKGK

SEQ ID NO: 9271 - protein, 732 aa, Xanthomonas campestris
MMSGVMTAVSNRWDPGAVRALAEARHGDAFAVLGAHPSDNGRFLRTYLPGADRVSAVLDDGQVVALDAGPEPGLFAGELPAHGGYRLRIGWPGGEQETADPYAFGPQLSDFDLHLISEGHHLQLADALGANVVEVDGVRGTRFAVWAPNASRVAVVGDFNSWDARRHPMRLRHQAGVWELFVPDVGPGAHYKYQLRGPHGHELPAKADPVARRAELAPGTASIVADPTPHQWSDDGWMATRARRQAHDAPMSIYEIHAGSWLREAGLDLDWDGLADRLIPYVADMGFTHVELMPVSEHPFGGSWGYQPLGLFAPTARFGTPDGFARFVDRCHREGIGVIVDWVPAHFPTDAHGLAHFDGTALYEHADPREGFHRDWNTLIYNHGRREVSGFLIASAMEFLQRYHVDGLRVDAVASMLYRDYSRNAGEWIPNIHGGRENYETIAFLRRLNEVVREHTPGAVMIAEESTAFPGVTADVAHGGLGFHYKWNMGWMHDTLHYAGLDPIYRRYHHGELTFSMVYAYSERFVLPISHDEVVHGKGSLLGRMPGDDWQRFANLRAYLGFMFTHPGRKLLFMGCEFGQPTEWNHDAGLPWHLLDDPRHRGVQTLVRDLNRLYVQYPALHAHDDDPSGFAWVVGDDAGNSVVAFLRKGKRGDAPVLVVINFTPVVQHGYRIGVPQGGQWREVFNSDAGIYGGSNLGNGGSVTAEQQSMHGHAQSLPLLLPPLGAIVLTPYG

SEQ ID NO: 9272 - protein, 474 aa, Clostridium acetobutylicum
MLSEFPKNFLWGASSAAYQVEGAWKEDGKGESVWDNFSKIPGKTFEGTNGDVAVDHYHRFKEDVALMAEMGLKAYRFSVSWSRIYPKGRGKVNLKGLEFYKNLVDELLKYNIEPVLTLYHWDLPQALQDLYGGFESRNVISDFENYCITLFKNFKDKVKYWITFNEQNVFTNLGYRCAVHPPGIKDIKKYYLANHIVNLANASAIKAFRKYVPNGKIGPSFGMGPVYSFDCKPENVLAGDEAEEYFNHWWLDVYCFGKYPTITLNRLEKLKVMPEITKEDLQLLREAKPDFIGLNYYHGGTVMANDNVIRENLDKKDPYLVENSEEDKGFKYISNPFLKKTEWNWEIDPQGLRIALRRLTNRYNLPILITENGIGAVDRLEEDERINDDYRIEYLKAHVLACKEAIDDGVQLIGYLPWSFTDLLSWLNGYKKRYGFVYINRDEHSQKDLRRIKKKSFYWYKDVIEKNSDNIYGR

SEQ ID NO: 9273 - protein, 366 aa, Prunus persica
QMGLAENQVSFDLLEKYLEEHSEASKWGSKGVPCFRENALFQDYHGLVSFRKAMASFMGQIRGGRAKFDPDRIVLTAGATAANELLTFIIADPGDALLVPTPYYPGFDRDLRWRTGVNIVPIHCDSSNNFQITPQALEAAYKDAEAKNMRLRGVLITNPSNPLGATIQRVVLEEILDFVTSKNIHLVSGEIYSGSTFSSSAFVSIAEILEARQYKNSERVHIVYSLSKDLGLPGFRIGTVYSYNDKVVATARRMSSFTLISSQTQHLLASMLSDKEFTENYIKTNRERLRKRYDMIIEGLKKAGIECLKGNAGLFCWMNLSPLLEKPTRGGELALWDSMLHEVKLNISPGSSCHCSEPGWFRVCFA

SEQ ID NO: 9274 - protein, 57 aa, Brassica oleracea
RIRSKKNELLFAEIDYMQKREVDLHNDNQLLRAKIAENERNNPSMSLMPGGSNYEQI

SEQ ID NO: 9275 - protein, 366 aa, Prunus persica
QMGLAENQLCFDLIEEWVLKNPEASICTAAGVNEFKDIAIFQDYHGLPEFRNAVANFMGKTRGNQVTFDPDRIVMSGGATGAHEMIAFCLADPGDAFLVPVPYYPGFDRDLGWRTGVQLIPVACVSSNGFKVTRAALEAAYEKAQKDNIRVKGLLITNPSNPLGTVLDRETLRSLVAFINEKKIHLVCDEIYAATVFSQPSFISIAEIIEEDIGCDRNLVHIVYSLSKDMGFPGFRVGIVYSYNDAVVNCARKMSSFGLVSTQTQHLIASMLSDNDFVDRFIAQSAKRLKARHMRLTMGLAQVGTSCLKSNGGLFVWMDLRQLLKEQTFEAEMALWHTIIHEVKLNVSPGSSFHCPEPGWFRVCFA

SEQ ID NO: 9276 - protein, 102 aa, Oryza sativa
MSSDGGPVLGGVEPVGNENDLHLVDLARFAVSEHNKKANSLLEFEKLVSVKQQVVAGTLYYFTIEVKEGDAKKLYEAKVWEKPWMDFKELQEFKPVDASANA

SEQ ID NO: 9277 - protein, 82 aa, Brassica rapa
PKELRNLEGRLDRSVNRIRSKKNELLFAEIDYMQKREVDLHNDNQLLRAKIAENERNNPSMSLMPGGSNYEQIMPPPQTQPQ

SEQ ID NO: 9278 - protein, 73 aa, Brassica oleracea
LEGRLDRSINRIRSKKNELLFAEIDYMQKREVDLHSDNQLLRAKIAENERNNPSMNLMPGGSNYEQIIPPPQT

SEQ ID NO: 9279 - protein, 188 aa, Arabidopsis thaliana
  misc_feature (177)..(177): Xaa can be any naturally occurring amino acid
MANNDEITTSSHASPAVNHESISRAKQRIKDGLATRRSWRVMFDLHSTGLPHGVSDVFSRIKTNLAYFRSNYAIVILNVIFFSLIWHPTSLIVFTGLVFLWIFLYFLRDVPLKVFRFQIDDRAVLIGLSVITIVLLLLTNATFNIVAALMAGAVLVLIHAVIRKTDDLFLDEEAATXETSGLTSHPSS

SEQ ID NO: 9280 - protein, 681 aa, Nicotiana sylvestris
MSGSGCSIVWFRRDLRVEDNPALAAGVRAGAVIAVFIWAPEEEGHYYPGRVSRWWLKQSLAHLDSSLKSLGTSLVTKRSTDSISSLLEIVKSTGATQLFFNHLYDPISLVRDHRAKEVLTAQGISVRSFNADLLYEPWEVNDEEGRPFTTFSAFWEKCLSMPYDPEAPLLPPKRIIPGDASRCSSDSLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFVGYKCDPHGEYVRRWLPELSRLPTEWIHHPWNAPESVLEAAGIELGSNYPLPIVEIDSAKVRLEQALSQMWQHEAASRAAVENGMEEGHGDSADSPIAFPQAMHMEMDHEPVRNNNPVIVTVRRYEDQMVPSMTSSLFRVDDEETSVNIRNSVVDTRAEVPNDVNVTEGPRRDTLDQAVTQPARTNTTPPQFNFVVGRRNSEDSTAESSSSTRERDGGVVPVWSPSSTNYSDQYVGDDNGIGTSSSYLQRHPQSHQLMNWQRLSQTG

SEQ ID NO: 9281 - protein, 641 aa, Nicotiana sylvestris
MESNSKTIVWFRRDLRIEDNPALAAAARNGSVFPVFIWSPKEEGQFYPGRVSRWWLKQSLIHLEQSLKSLGAELVLIKAQSTLSALLDCIEAVGATKVVYNHLYDPVSLVRDHNIKQKLGELGISVQSYNGDLLNEPWEVYDDDGKVFTTFDAYWEKSLRLQKEPVSHLPPWKLIPAAGSVKMCSVEELGLENESEKSSNALLGKGWAPGWSNADKALTEFVENQLLAYSKDRLRVGGNSTSLLSPYLHFGEVSVRKVFNSVRLKQILWTKEGNSVGDESASLYLRAIGLREYSRYICFNFPFTHERSLLNNLKFFPWNADQARFKAWRQGRTGYPLVDAGMRELWATGWIHNKIRVIVASFFVKFLLLPWQWGMKYFWDTLLDADLESDIIGWQYISGSLPDGHELERLDNPEVQGFNYDPEGEYVRHWLPELARMPAEWIHHPWDAPLTVLKAAGVELGMNYPNPIIDVDVARDRLMQAIFIMREKEAAANAADANGTNEVVFDNSENVGDSVNPKVVKGKVPCPSSSSYDQRVPSMQKGSTNKKRPNPVEEEKKFKDNWLSCKIKTEGKISKADDDLCSTAESSSMKKQMTTSRNSFSVPQAISMSYDIKSFDGEASSHVKLQNEEEIDMEINSCKNE

SEQ ID NO: 9282 - protein, 296 aa, Saccharum officinarum
MSGGGQDLQLPPGFRFHPTDEELVMHYLCRRCASLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAASSGDHKPMVFAAGAVSSPPEQKPFVATPGGLPPAAFTADLAAYYDRPSDSMPRLHADSSCSEQVLSPEQLACDREVQSQPKISEWERTFASDPVNPAGSMLVDPVVGGHAGDPLLQDILMYWGKPF

SEQ ID NO: 9283 - protein, 157 aa, Triticum aestivum
MAGMVFGLDAPMMAALQHLLDIPDGEAEPPPEKQGPTRAYVRDARAMAATPADVKELPGAYAFVVDMPGLGSGDIKVQVEDERVLVISGERRREEKEDAKYLRMERRMGKLMRKFVLPENADMEKISPCRDGVLTVTVDKLPPPEPKKPKTIQVQVA

SEQ ID NO: 9284 - protein, 454 aa, Aeropyrum pernix
MEEVVKRLAEIRAMDARGEGGRLFTYLYETGDPGVKEVSLRAFEMFLDTNALDPTVFKSALFFERELVSFASSLAGGVEGVVGTVTYGGTESIILAAMAAREWYRSLGGSRTPGIVAPQTVHPSVRKAARYLGMRLSIAPVDPGSKRVDIDSLVSLVDDRTAMVVVSAPNYPYGTVDDVRSVAEALSSQRVWLHVDACVGGFILPFMRELGLYSGAFAFDVEGVYSVSMDLHKYGYSPKGASVLLFRDGSLKKHSIFADLRWPGYPFINTTVLSSRSVAPLAAAWAVTNYLGRRGYLELARKAVEARDEIMRGLESIGFRSLAPIESTILSVALDDPADTLRFHANMSRRGWILGLQPGVEGLAPPNIHLTISPIHKLVSPQFLGDARASSSEPLPKELEEAWRLLESRGPLELAGMIGRTQYDQVIIAWILSSIPPDLAEDLARELTVEVYRG

SEQ ID NO: 9285 - protein, 335 aa, Unknown
  Polaromonas sp. JS666
MSQRISLTRYLVEQQRREGHIPAQLRLLLEVVARACKGISQSVNKGALGGVLGTAGSENVQGEVQKKLDIIANEVLIEANEWGGHLAAMASEEMDSIYLVPNRYPQGEYLLLFDPLDGSSNIDVNVSIGTIFSVLKKPDDHAGVEEKDFLQPGNKQVAAGYCVYGPQTTLVLTVGDGVAMFTLDREQGSFVLIEENVRIPEDTKEFAINMSNMRHWDAPVKRYIDECLQGTEGPRGKDFNMRWVASMVADVHRILSRGGIFMYPWDKREPEKAGKLRLMYEANPMGWIVEQAGGSATNGKQRILDIQPGKLHERVSVILGSKNEVERVTGYHSGL

SEQ ID NO: 9286 - protein, 443 aa, Colwellia psychrerythraea
MTVKLTLPTQSKMLSKDFVYGVATASFQIEGGKASRLPCIWDTFCDTPNTIADGSNGEMACDHFNRWQDDIELIDSIGVDAYRLSISWPRVITESGELNQEGVAYYMNILDTLKSKRIKAFVTLYHWDLPQHLEDKGGWLNRETAYEFRNYANLISKVFGNRVHAYATLNEPFCSAFLGYEVGTHAPGIIGKEFGKKAAHHLLLAHGLAMEVLAKNSPNTLNGIVLNFTPCYPESESLADINAAAFADDYFNQWYIKPLFDGKYPEILSTLPAAHQPDIHEGDMAIIAHSMDYLGVNFYTRAIYRADVDEHFLQIDPPEPRTDIGWEIYPKAFTELLVSLNEKYRLPPVYITENGAAMADKIIDGVVNDQDRVDYYQQHLNAVNDAIEQGVKVDGYFAWSLMDNFEWAEGYLKRFGIVYVDYETQVRTIKASGFAYKALITNR

SEQ ID NO: 9287 - protein, 464 aa, Caulobacter crescentus
MRKYLLIGVSAFVLGAGTMAYISPIAQANNAPKAQTYKLLELFGDVLGTVEDQYVTEVDDKKLIEAALDGMLTSLDPHSGYLAPDAFEDMQDTTRGEYGGLGLEVTSEEGVVKVISPMDGTPASRAGIQAGDYITAVNGQSVLGLTVNEAVKQMRGTAGEAVTLTIAREKTDPFDVKLVREVIKPKAAIARMEGDYGYVRLPGFNEKATDALASSVSELKSKNPKMKGLILDLRNNPGGLLDQAVGVADVFLDGGEVVSQRGRDPRNIQRYNARGGDMLNGLPMVVLINQGSASAAEIVAGALQDRKRAEVVGLTSFGKGSVQTVIPLRGGADGALKLTTARYFTPSGRSIQKTGIAPDLEVAQTRDQAQDIANRVWFSEASFKNALNADEGKSRVGAHTPAEAPPTGFDDKKGDFQLQRAIAVLQAGGVAKTPKLPKPAAKVAEVTAKAAAAAGGKTPVTEVK

SEQ ID NO: 9288 - protein, 664 aa, Listeria monocytogenes
MTDYPSIFEPLTVKRMTIKNRVIMPPMGTNLAGLNGEFLEEHMNYYEQRAKGGTGLITIENACVDFPYGTNGTTQLRIDNDQYIPGFYKLTERLHKHGTCVSIQINHAGASAYPARLNGLQPVSASDIPSKKGGTVPRPLTVEEIYEIVNKYGDAARRAQQAGFDAVEIHGGHSYLLCQFLSPLYNKRTDEFGGTPENRARIVKLILEKVRAEVGPFFPIVLRFSADEFTEGGNHLEDILELLDYCQEEADILNVSAAINDNLYLQIDQMNLEDGWRSYLAKAVKDKFNKPTITSGNIRSPKAAEKILSEGYADLLAMGRGLIAEPNWVNKVATGQEDMLRKCISCNIGCADHRISKSKPIRCTVNPDIIHEDKYKETKVTRPTNVVVIGGGTAGLEAACTAAEVGCNTTLIEANEQTGGLARAIANLPDKSRIADFPNYLANRAEKLTNLKVITGTKADTALIDTFNPDVVVNATGSKPLLPPIKGLLDVIDKEGSKVHSIFGLISNIDDFTEFSNKKVAVIGGGAVGLDVVEYFSERGSDVTIVEMMPLLGKDLDMITRLSMMDIIEKNHVDVQTETALTEVAADHFKVKHDGVDAEIPFDYGFVCLGMRPERPLMEELAAYGKEKQIEIVNIGDSAATRKILEGVREGRNILTTLEKIGSL

SEQ ID NO: 9289 - protein, 538 aa, Zea mays
MALPKIPMRHHKAPAPVSCEGASELARKDPDSPTPASHKVQPRCYRNAEKCLTLPESATCAVAATATASTSRTGRFIGLVAGFSGTSKKGRRWAAMEDAMAADGKSVLQGRYELGRVLGHGNFGRVHAARDLRTGRSVAVKVVAKDKLERAGMAEQIKREIAVMKMVSHPNIVELHEVMATRSKIYLALELVRGGELFSRIARAGRVREDVARCYFRQLVAAVDFCHGRGVFHRDLKLENLLLDEVGNLKVADFGLSALAGHARSDGLLHTACGTPSYVAPEVLGGKGYDGAKADLWSCGVILYVLLVGSLPFHEDNLMVMYRKMQRGEFLCPPWVSADARKLIGELLDPDPSTRITVARLVETPWYRKPLPVLPPLNLKEPTPDARRATSDKEEPEVLNAFHLISFSEGFDLSPLFDQGRGGGVGRSSAGGIRFVTREAASSVVSRLESLVTGRGANMRVTKSGSRGVRLEAVSRGRSGARLAVAAEIFSVAPSVLLVDVKKDGGDTMEYRSFCSEELRPALKDIVWASSQDTPGAA

SEQ ID NO: 9290 - protein, 612 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 9291 - protein, 371 aa, Burkholderia fungorum
MSTDSARIDSYLFEPVELGPLQLPNRIVMAPLTRSRAKEGDVPGELAIEYYAQRASAGLIIAEATQISPQGKGYVFTPGIYNDAQVQAWKRITGAVHEKGGRIFLQLWHVGRISHPSLQPGNALPVAPSAIKPEGQAYTNEGFVPLVTPRALETSEIAGIVEQYRVAAQNAKAAGFDGVEIHAANGYLLDQFLRDKTNRRTDQYGGSIGNRARLLLEVADAVTGVWGSDRVGVRISPLSSFGDIADSNPEPLFTYVVQQLSARKLVYLHVIEGDTGGPRDVPGGFDLQVLREAFDGLFMANNGYDMELAQRTLKAKRADLIAFGRPFISNPDLVARLRSGAPLNEPDKDTMYGGGAEGYIDYPTMEQEAKR

SEQ ID NO: 9292 - protein, 464 aa, Clostridium perfringens
MLFGKNELGSQFETPIFGTVESNESIPKYELAKKSIAPQVAYRLIKDDLLDEGNARQNLCTFCQTYMDDEAVKLMAETLEKNAIDKSEYPQTTDLENRCVNILADLWHAPKDESFMGTSTVGSSEACMLGGMAMKFRWRNRAKALGMDVTSRKPNLVISSGYQVCWEKFCVYWDIEMRLVPMDEEHMSINVDKVLDYVDDYTIGVVGILGITYTGKYDDIKALDKKLEEYNKTAKLTVPMHIDAASGGMFAPFIEPELEWDFRLKNVVSISTSGHKYGLVYPGIGWVLWRDKEYLPQELVFDVSYLGGKIPTMAINFSRSASQIIGQYYNFLRYGFEGYRQIHQRTKDVAMFLASELEKTGLFQIYNNGENLPIVCYKLRDDVNVDWTLYDLADRLLMKGWQVPAYPLPADLQDTIIQRIVCRADLSHNLAELYLRDLKAAIEDLNNARVLNQKSKTGVQGFTH

SEQ ID NO: 9293 - protein, 894 aa, Musa acuminata
MNSVRSGFLIQAAFLVMISGSSNMGVSGLGSMSSIAVSYGENGPVFCGLSSDGSHLVACFGADASIVYGAPLRLPLLGLTAGDGFVCGLLLDTGQPYCWGSNIFVKMGVPQPMAEGASYSEISAGDDHLCALRKPAIDSRKGASLIDCWGYNMTASHEFDGSVAAITAGSVFSCGMFIHNRTAFCWGDETSSGVISLTPRNLRFQSISAGGFHVCGILENSQVFCWGRSLETQQLSLGHGDVKMVPMDPMVSVAGGRFHACGIKSLDHKAVCWGFMLQNSMPPPKDSRLYEIAAGDYFTCGVLAATSLRAVCWGTGVPWSIPMAVSPGICASNPCGQGYYEFSHTSWGNKVCKPADSRVCLPCSVGCPEGTYESTPCNLTSDHGCEFNCSSCASVECSSFCSSQKESKSKRLLSLQMPIFIAEIVFAIIFVSSVFLVACLYARHRLQSCRCLESAVTTSRKRTYSFHKEMVKVRPDLEELKIRRAQMFTYGELEKATSGFSEESLVGKGSFSCVFKGVLKDGTVVAVKRAIRVSDVKKNSKEFHTELDLLSRLNHAHLLNLLGYCEEGGERLLVYEFMAHGSLYRHLHGKDLCLRKRLDWVRRVTIAVQAARGIEYLHGYACPPVIHRDIKSSNILIDEEHNARVADFGLSLLGPVDSSSPLSEPPAGTLGYLDPEYYRLHYLTTKSDVYSFGVLLLEILSGRKAIDMQFEEGNIVEWAVPLIKAGDISAILDPVLKPPADLEALKKIAAMASKCVRMRGKDRLSMDKVTTTLERALALLMGSPCNEQPILPTEVVLGSSRLHNKASQRSSNRSCSENDTDDQIYEYRAPSWITFPSVTSSQRRKSSASEGDAEGKNSEGRSLGHGGAGDGLRCLEEEIGPASPQENLFLQHNF

SEQ ID NO: 9294 - protein, 187 aa, Equisetum arvense
DEHGEVVAEIRRADLEPYLGLHYPATDIPQASRFLLMKNRVRMIHDCRAPPIRVIQDEHLPQPLSLAGSALRAPHGCHAQYMENMGSIASLVMAVTLNDNEFDNANESLKRRKLWGLIVCHHTSPRAVPFLRSACEFLMQVFGLQLNMEVELAAQMREKHILRTQTLLCDMLLRDAPIGIVTQSPNI

SEQ ID NO: 9295 - protein, 199 aa, Brassica rapa
MAMLGGVRDVPSNENSVEVESLARFAVDEHNKKENALLEFARVVKAKEQVVAGTMHHLTLEIIEAGKKKLYEAKVWVKPWLNFKELQEFKPSTTITPSDLGCKKGEGASGWREVPGDDPEVQHVADHAVKSIQQRSNSLFPYELQEVVHANAEVTGEAAKYNMVLKLKRGEKEEKFKVEVHKNHEGVLHLNHMEQQHHD

SEQ ID NO: 9296 - protein, 205 aa, Colocasia esculenta
MALMGGIVDVEGAQNSAEVEELARFAVDEHNKKENALLQFSRLVKAKQQVVSGIMHHLTVEVIEGGKKKVYEAKVWVQAWLNSKKLHEFSPIGDSSSVTPADLGVKRDAHEAEWLEIPTHDPVVQDAANHAVKSIQQRSNTLFPYELLEILHAKAKVLEDLAKIHLLLKLKRGSREEKFKVEVHKNIEGTFHLNQMEQDHSDSGN

SEQ ID NO: 9297 - protein, 312 aa, Arabidopsis thaliana
MAQQGQGSMDPAVLDDIIRRLLDYRNPKAGTKQAMLNDSEIRQLCFVSREIFLQQPCLLELAAPVKICGDIHGQYSDLLRLFEYGGFPPAANYLFLGDYVDRGKQSLETICLLLAYKIKYPENFFLLRGNHECASINRIYGFYDECKRRFNVKLWKVFTDTFNCLPVAAVIDEKILCMHGGLSPELINVEQIKNIERPTDVPDAGLLCDLLWSDPSKDVKGWGMNDRGVSYTFGADKVAEFLIKNDMDLVCRAHQVVEDGYEFFADRQLVTMFSAPNYCGEFDNAGALMSVDESLMCSFQILKPVDRRSRFF

SEQ ID NO: 9298 - protein, 182 aa, Trichoderma atroviride
  misc_feature (56)..(56): Xaa can be any naturally occurring amino acid
QRQAEGKPTDKPNIIMSSAVQVCWEKAARYFEVEEKYVYCTPDRYTIDPQQAVDLXDENTIGIAAILGTTYTGHYEDVKGINDLLEEKGLDVSIHVDAASGGFVAPFVLPDLEWDFRLPRVVSINASGHKYGLVYPGVGWVVWRSHEYLPQDLIFNINYLGAEQSSFTLNFSKGASQVIGQY

SEQ ID NO: 9299 - protein, 371 aa, Burkholderia fungorum
MNASSELKLLSPARVGPLSLAHRVVLAPMTRLRSDADDSPSAMMVEYYRQRASQGGLLITESAHPSYDSRGYIGAPGIYTNAHVEAWRKITDAVHARGARIFMQIAHDGRQSHVDLSWGNAPVAPSVVPYETTVFTQNGWVPNSPHRALELDEIPALIRSFRDAAARAKDSGFDGVELHNANGYLADTFLQDGTNKRTDAYGGSVEKRARFSLEAVEAFASVWGADRVGVRVSPSGRWGAISDNHPEATFGYFAQRLNEYGLAYLHVIEPRVMGTETLTEGEAPVASAFLRKVFTGPIIAAGGFDRDGAEQILQRGDADLVAFGRWFSSNPDLPERFRLGHALAPYNREAFWGGDERGYIDFPSLPEHAAA

SEQ ID NO: 9300 - protein, 547 aa, Corynebacterium efficiens
MAKIIAFDEEARRGLEKGLNTLADAVKVTLGPKGRNVVLEKAWGAPTITNDGVTIAREIELEDPYEKIGAELVKEVAKKTDDVAGDGTTTATVLAQALVKEGLRNVAAGSNPMGIKRGIEQAVATVTEKLLESAKEVETEEQIAATAGISAADPAIGAQIAKAMYAVGGGKLNKDSVITVEESNTFGVELEVTEGMRFDKGYISGYFATDMERLEAVLEDPYILLVSGKISNIKDLLPLLEKVMQSGKPLLIIAEDVEGEALSTLVVNKIRGTFKSVAVKAPGFGDRRKAQLQDIAILTGGQVISEEVGLSLETADLPLLGQARKVVVTKDDTTIVDGAGSEEQIEGRVNQIRAEIENSDSDYDREKLNERLAKLAGGVAVLKVGAATEVELKERKHRIEDAVRNAKAAVEEGIVAGGGVALIQAAHVLDNDLDLTGDEATGVRIVRDALTAPLKQIAANAGLEPGVVADKVSRLPEGEGLNAATGEYVDLMAAGINDPVKVTRSALQNAASIAALFLTTEAVVADKPQPAGAAMPGADEMGGMGGF

SEQ ID NO: 9301 - protein, 275 aa, Agrobacterium tumefaciens
MGKSGRRMRRFWPANGEDTMKPLEIDVFLCRSDNFGVLLHDPESGATAAIDAPEEGPILRALDGHGWKLTHIFTTHHHQDHVEANLVLKDKFRCEVHGPYDEAIAIPGLDRSQADGDEFEFAGRRVQVIATPGHTAGHICYYLPDDGLLFAADTLFAMGCGRLFERPAADMWHSFQKLMALPDDTRVYFGHEYTLSNARFALTVDPDNAVLRERAARVETARQANEFTIPTTIGLEKQTNPYMRVADAGIRRHLGLEGAADADVFAEIRTRKDNF

SEQ ID NO: 9302 - protein, 177 aa, Helianthus annuus
MSIVPSLFGSRRSSIFDPFSLYVWDPFRDFPISTSSEVSRETSALVNARVDWKETPEAHVFKADLPGIKKEEVKVEVEDGNILQITGERNVEKEDKNDKWHRVERSSGKFTRRFRLPENAKMDQVKAAMENGVLTITVPKEEAKKPDVKSIEISVKKIYEFARFIVLDRLYDLYVFI

SEQ ID NO: 9303 - protein, 314 aa, Aspergillus nidulans
MSLADTTYKLNTGAEIPALGLGTWQSAPGEVSAAVYHALKVGYRHIDAAQCYGNETEVGEGIKRALSEGIVKRSEIFVTTKLWCTYHTRIQQALDLSLSKLGLDYVDLYLVHWPLAMNPNGNHDLFPKLPDGSRDLVREHSHVTTWKGMEELITNNPDKVKAIGVSNYSKRYLEQLLPQAKIVPAVNQIENHPALPQQEIVDLCKEKGILITAYSPLGSTGSPLFKAEAIVAVAERRGVTPASVLLSWHLARGSSVLAKSVTPSRIEENRKLVKLEPEDVELIGKYSAELAATNGFQRYVYPPFGVDFGFPDKS

SEQ ID NO: 9304 - protein, 155 aa, Helianthus annuus
MSIIPSLFAGRRSSVFDPFSLDVWDPFRDFPISSSSDVSRETSALVNARVDWKETPEAHVFKADLPGIKKEEVKVEVEDGNILQITGERNVEKEDKNDKWHRVERSSGKFTRRFRLPENAKMDQVKAAMENGVLTITVPKEEVKKPDVKSIEISG

SEQ ID NO: 9305 - protein, 81 aa, Brassica rapa
  misc_feature (57)..(57): Xaa can be any naturally occurring amino acid
PKELRNLEGRLDRSINRIRSKKNELLFAEIDYMQKREVDLHSENQRLRAKIAENERXNPSMNLMPGGYEQTMQPPQTQSQP

SEQ ID NO: 9306 - protein, 152 aa, Zea mays
MSLVRRSNVFDPFSMDLWDPFDTMFRSIVPSATSTNSETAAFASARIDWKETPEAHVFKADLPGVKKEEVKVEVEDGNVLVISGQRSREKEDKDDKWHRVERSSGQFIRRFRLPDDAKVDQVKAGLENGVLTVTVPKAEEKKPEVKAIEISG

SEQ ID NO: 9307 - protein, 69 aa, Arabidopsis thaliana
NLEGRLERSITRIRSKKNELLFSEIDYMQKREVDLHNDNQILRAKIAENERNNPSISLMPGGSNYEQLM

SEQ ID NO: 9308 - protein, 544 aa, Desulfitobacterium hafniense
MAKQIVFNEEARRALERGVNALAESVRVTLGPKGRNVVLDKKFGAPLITNDGVTIAREIELEDPFENMGAQLVKEVATKTNDVAGDGTTTATVLAQAIIREGLKNVAAGANPMGIKRGIEKAVESVVEDIKTNAKPIESKESIAQVASISAGDDNIGVLISDAMEKVGKDGVITVEEAKGMTTELKVVEGMQFDRGYLSAYMITDTDKMEAILNDPYILITDKKIGAIADILPVLEKVVQAGRQLLIIAEDIEGEALATLILNKLRGTFTCVAVKAPGFGDRRKAMLEDIAILTGGTVITEDLGLKLENTTIDMLGRARQIRVTKEETTIVEGSGSQDDIKSRVEAIKKQIDETTSDFDREKLQERLAKLAGGVAVIQVGAATEVEMKEKKLRIEDALAATRAAVEEGIVAGGGCALVDAAKALDSLKLTGDEKTGVAIVCRALEEPLRQIANNAGFEGSIVVEKVRNGGRGVGFNALTEAYEDMIAAGIVDPAKVTRTALQNAASIAAMLLTTECLVSDIPSKDNGAAAMAGMGGMGGMGGMM

SEQ ID NO: 9309 - protein, 529 aa, Bdellovibrio bacteriovorus
MTHSVYEALLNSNAVIEFDNQGYILWANPNFLNLMEYELDEIEGRHHSIFLPEFHQHELEYQEMWNQLAEGHAQAGEFKRLTKKNREVWIQGSYTPVRNLQGEISKIVKMAVDITEKKSLADNLEKKNKELLGAATKAKAATDAKTVFLANMSHEIRTPLNSIIGITDTLAETPLDNQQASFVEILQRANHQLMTIINDILDLSKVEAGEMELRPLPFNLQRLLDELEAVLGFRAKEKGLKLSLAIDPDVEEYFVGDADRLRQVLMNLLNNSLKFTNNGEISLQVSVNRTVHKGNLLFCVTDTGIGISKQKFKDIFQPFTQADTTTTRKYGGTGLGLSITKNIVQMMNGHIWFESQPGQGTSFFFTISVPSTTERKTTMHNPWQGRYQLTDVNHNISSSRRRILVVDDVEDNRHLFGIYLQKTAHAVSYASGGLEAVEMVAKEHYDIIFMDVQMPGMDGYEATRRIRDMEIQMNRTPAKIFACTANAFQEDVRKSLSAGCDLHLSKPVRKDTMLKAISSCFNDAQEAIY

SEQ ID NO: 9310 - protein, 374 aa, Solanum melongena
LQEFDPDQMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATALCQPSFISISEVMNEVVGCNDDLVHIVYSLSKDLGFPGFRVGIIYSYNDVVVNIARKMSSFGLVSTQTQRLIASMLSDTIFVENFIAKSAMKLSQRHDLFTKGLGQVGITTLKSNAGLFIWMDLRRFLENSTFDDELKLWHIIINKVKLNVSPGCSFHCSEPGWFRVCFAA

SEQ ID NO: 9311 - protein, 610 aa, Pseudomonas chlororaphis
MCGLTGWVDYTRRLEGEDPAIRAMTNTLALRGPDAEGIWKHRHALLGHRRLAVIDLSGGTQPMVYRFADGQEVSLVYTGEVYNHDALRDQLRQAGHVFQTRSDTEVVLHAYLEWGERCCDHLTGMFAFALFDGRDGHLLLVRDRLGIKPLFYARHREGLLFGSETKAILAHPEFTTGLEVTGLVDVLTLSKGTAQTPFRNLMELLPGHFLSWRPNGQMKIQSYWKVRRQEHQHDLQTTVQQTRELVTHALGSQLHADVPVCSLLSGGLDSTTLTAIAQRIVKAKTGGNINSFSVDFTGQAEQFKSDDLRPDQDQPFALLAAEFIGSRHQTVLIDNEELVSYLAREEVFRARELPFTFGDMDTSLNLLFREIRKHSTVAISGEGADEVFGGYGWFRDPKVIASASFPWSSRVKLPAGFINADFNRQCDLAQYQQASYDDALLQVEHLAQDSPHERRMRELCHMHLKRWMVMLLDRKDRLSMCNSLEVRVPFTDHELVEYIYNVPWSIKSKDGEEKWLLKQACADFVPEAVLKRRKSPYPTSADLGYERFLRQSARQLLQDTGNPVFGIVSHAYMAEELRQPEGYFNTQISRHSLETALALDAWLRLHKISL

SEQ ID NO: 9312 - protein, 234 aa, Solanum tuberosum
  misc_feature (30)..(30): Xaa can be any naturally occurring amino acid
MRVIRSTAILILFLLSVFGLSEQGKAGGFXSEEMATLGGVHDSHGSSQNSDEIHSLAKLAVDEHNKKENAMIELARVVKAQEQTVAGKLHHLTLEVMDAGKKKLYEAKVWVKPWLNFKELQEFKHVEDVPTFTSSDLGVKQVEQTSGLKSVPVHDPVVEEAAEHAIKTIQQRSNSLLPYELQEIVHANAEMADDHTKLHLVIKTSRGGKEEKFKVQVQHNNEGAFHLNHMEPDN

SEQ ID NO: 9313 - protein, 492 aa, Capsicum annuum
MDLSKYRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHTRGSPESIRDILGFAVKFYTREGNFDLVGNNVPVFFNRDTKSFPDTIRALKPNPKSHIQENWRILDFFSFLPESLHTFAFFYDDVCLPTDYRHMEGFGVHAYQLINKAGKAHYVKFHWKPTCGVKSMTEEEAIRVGGTNHSHATKDLYDSIAAGNYPEWKLFIQIMNPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRSWAPDRQDRYINKWVESLSDPRVTHEIRSIWISYLSQADKSCGQKVASRLTVKPTM

SEQ ID NO: 9314 - protein, 245 aa, Gymnosporia polyacantha
ALSIAGAVQSQKLAVRAISQLQSLPGGDIKLLCDTVVESVRNLTGYDRVMVYKFHEDEHGEVVAESKRSDLEPYMGLHYPASDIPQASRFLFKQNRVRMIVDCHASPVRVIQDDGLMQPLCLVGSTLRAPHGCHAQYMENMGSLASLAMAVIINGNEEEAIGGRSPTRLWGLVVCHHTSARCIPFPLRYACEFLMQAFGLQLNMELQLAAQLLEKHVLKTQTLLCDMLLRDSPTGIVTQSPSIMD

SEQ ID NO: 9315 - protein, 532 aa, Schizosaccharomyces pombe
NKLLFNRFASSQSKDSNISEMNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 9316 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQKGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 9317 - protein, 245 aa, Gymnosporia polyacantha
ALSIAGAVQSQKLAVRAISQLQSLPGGDIKLPCDTVVESVRNLTGYDRVMVYKFHEDEHGEVVAESKRSDLEPYIGLHYPASDIPQASRFLFKQNRVRMIVDCHASPVRVIQDDGLMQPLCLVGSTLRAPHGCHAQYMENMGSLASLAMAVIINGNEEEAIGGRSPTRLWGLVVCHHTSARCIPFPLRYACEFLMQAFGLQLNMELQLAAQLLEKHVLKTQTLLCDMLLRDSPTGIVTQSPSIMD

SEQ ID NO: 9318 - protein, 358 aa, Hippocratea volubilis
QSQKLAVRAISQLQSLPGGDIKLLCDTAVESVRDLTGYDRVMVYKFHEDEHGEVVAESKRPDLEPYIGLHYPATDIPQTSRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSTMDLVKCDGAALYYQANYYPLGVTPTEAQIKDIVEWLLVFHGDSTGLSTDSLADAGYPGATLLGDAVCGMAVAYITNRDFLFWFRSHTAKEIKWGGAKRHPEDKDDGLRMHPRSSFKAFLEVVK

SEQ ID NO: 9319 - protein, 236 aa, Arabidopsis thaliana
  misc_feature (160)..(160): Xaa can be any naturally occurring amino acid
  misc_feature (192)..(192): Xaa can be any naturally occurring amino acid
  misc_feature (199)..(199): Xaa can be any naturally occurring amino acid
  misc_feature (206)..(206): Xaa can be any naturally occurring amino acid
  misc_feature (213)..(213): Xaa can be any naturally occurring amino acid
  misc_feature (219)..(219): Xaa can be any naturally occurring amino acid
MSSYSIASAISRISPLIRFVKPYSTGFSFITCACNSTRRPKRFDQLCVFSMASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFXKGYHNGNSEPRGFGHIGVTVDDVHKACERFEXLRVEFAXEPNDGKXEDIAFIXDPDGYXNQDFDLKTIGTTTVNAA

SEQ ID NO: 9320 - protein, 374 aa, Hippocratea volubilis
ALSIAGAVQSQKLAVRAISQLQSLPGGDIKLLCDTAVESVRDLTGYDRVMVYKFHEDEHGEVVAESKRPDLEPYIGLHYPATDIPQASRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSTMDLVKCDGAALYYQANYYPLGVTPTEAQIKDIVEWLLVFHGDSTGLSTDSLADAGYPGATLLGDAVCGMAVAYITNRDFLFWFRSHTAEEIKWGGAKHHPEDKDDGLRMHPRSSFKAFLEVVKSRSLPWEN

SEQ ID NO: 9321 - protein, 154 aa, Zea mays
MSLVRRSSVFDPFSVDLFDPFDSMFRSIVPPSLSSSAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 9322 - protein, 374 aa, Hippocratea volubilis
ALSIAGAVQSQKLAVRAISQLQSLPGGDIKLLCDTAVESVRDLTGCDRVMVYKFHEDEHGEVVAESKRPDLEPYIGLHYPATDIPQASRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSTMDLVKCDGAALYYQANYYPLGVTPTEAQIKDIVEWLLVFHGDSTGLSTDSLADAGYPGATLLGNAVCGMAVAYITNRDFLFWFRSHTAKEIKWGGAKHHPEDKDDGLRMHPRSSFKAFLEVVKSRSLPWEN

SEQ ID NO: 9323 - protein, 316 aa, Thermobifida fusca
MSELSANSTQRRAPEPEILDEKRSRTERYTIFTFVFVPLLALAAAVPFAWGWGLTWLDVAIGAVFYLIGGLGITVGYHRLFTHGSYRAARPLKIALAIAGSLAIEGGVIKWVADHRRHHKYSDHEGDPHSPWRFGDDWRSVAKGMFYAHMGWLFLDEQKTSPKRFAPDLLKDKDLVRIDRYFWVFVLISLLTPPLIGGLVTMSWWGACTAFFWGSLVRIALLHHVTWSVNSICHTIGEENFTVRDRSRNVWWLAIPSFGESWHNLHHAEPTCARHGVLKGQIDISARVIWIFEKLGWATKVRWPDPERLAAKRVAA

SEQ ID NO: 9324 - protein, 355 aa, Shewanella oneidensis
MTIENTVNSVENLFDTYKLNDTITLKNRILMAPLTRCMADANLVPTDDMVAYYARRAEAGLIISEATIIRPDAQGYPNTPGIFTQAQIAGWRKVTDAVHANGGKIFVQLWHTGRVAHPHFFGGGDVLAPSAQKIEGSVPRMRELTYVTPKAVTVEDIQGLVRDYAKAAENAIEAGFDGVEIHGANGYLIDQFLHHDSNRRTDEYGGTPVNMSRFALEVVDAIIARIGHDRTGLRISPGAYFNMASDSRDRVVFDYLLPELEKRDLAFVHIGIFDDSIEFDYLGGTASSYVRAHYGKTLVGVGSYSAETASKAIAEDKFDLIAIGRPFIANPDYVAKVRNSEELVAYSDEMLASLI

SEQ ID NO: 9325 - protein, 473 aa, Salmonella enterica
MPTHLVWFRRDLRLQDNLALAAACRDASARVLALYISTPAQWQAHDMAPRQAAFISAQLNALQTALAEKGIPLLFHEVADFNASIETVKNVCRQHDVSHLFYNYQYEFNERQRDAAVEKTLPSVICEGFDDSVILAPGAVMTGNHEMYKVFTPFKNAWLKRLKEDIPPCVPAPKIRVSGALSIPLTPVSLNYPQQAFDAALFPVEENAVIAQLRHFCSQGADEYASRRDFPAVDGTSRLSASLATGGLSPRQCLHRLLAEQPQALDGGPGSVWLNELIWREFYRHLMTWYPALCKHQPFIRWTKRVAWQENPHYFQAWQKGETGYPIVDAAMRQLNATGWMHNRLRMITASFLVKDLLIDWWLGERYFMSQLIDGDLAANNGGWQWAASTGTDAAPYFRIFNPTTQGERFDRDGEFIRQWLPALRDIPGKAIHEPWRWAEKAGVVLDYPRPIVEHKQARIATLSAYEAARKGA

SEQ ID NO: 9326 - protein, 533 aa, Neorickettsia helminthoeca
MPNEVISGEQLQKVIREAADLVVSSAGVTLGPEGRPVIMSKSYGGPEVTKDGYKVINALKPEDEKVAKIVELLNQATSQANEKAGDGTTTATMLVGNMIKNAHKHIAAQRSRMKLKAGMKRARDAVVKHIQSIAKKIDSEEEIAQVASISANGNSEIGNKIAEAMNKVGKEGVITVEEGKGLEEFSVSVVKGMVFDRGYVSPYFITNSEKMIVEFDNPYILIANKKLSSIQPMVSLLETIVRSNRAVVIIAEDVEGEALTSLVLSKMRGSLKACAVKAPGFGDRRAEMLEDIRILTGARSLVSDDIGVTVESLTVEDLGTAKSIIISKDSTTIVDGNGSKDAISARVNQIKTQIEKTTSDYDKEKLQERLAKLAGGVAVLKVGGATEVEVKERKDRVEDALHATRAAVEEGIVPGGGATLLNAIKVLEELSSDDDDEQAGINIVKAALKAPISQIVENAGEDASVIVHNLLESKDINRIFDARKLQYVDAFKAGIIDPAKVVRVALESAVSVASVLVTTEALIVDLPTKDNAG

SEQ ID NO: 9327 - protein, 557 aa, Oryza sativa
MDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKISWLSLHNYYSLTDMIMLQNCTKMFKQVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 9328 - protein, 357 aa, Triticum aestivum
  misc_feature (175)..(175): Xaa can be any naturally occurring amino acid
  misc_feature (222)..(222): Xaa can be any naturally occurring amino acid
  misc_feature (254)..(254): Xaa can be any naturally occurring amino acid
  misc_feature (279)..(279): Xaa can be any naturally occurring amino acid
  misc_feature (343)..(343): Xaa can be any naturally occurring amino acid
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLGAYSDSRGIPGVRQEVAEFIQRRDGYPSDPELIYLTDGASKGVMQMLNAIIRNERDGILVPVPQYPLYSAAISXLGGSLVPYYLEEEANWGLDLVSTRQSVAEARSKGITVRAMVIINPGXNPTGHCLKSEANIRELLNFCYQENLVLLADEXVYQQNGYQDERPFISARKVMFDMGXPPVSREGQLIPFHTVSKGYWGECGQRGGYFEMTNIPPKTVDEIYKVASIPLSPNVPGRIFMGLXEPPKPGRHSYLNIC

SEQ ID NO: 9329 - protein, 374 aa, Zea mays
AAVLTGAVRAIKVLDRNHVLRHRMVEQIKREISTMKLIKHPNVVQLHEVMASKTKIYMVLEFVDGGELFDKIVNSGRLGEDEARIYFHQLINAVDYCHSRGVYHRDLKPENLLLDSNGALKVSDFGLSAFAPQTNEDGLLHTTCGTPNYVAPEVLADKGYDGMAADVWSCGIILFVLMAGYLPFDDANLMRLYKLICQAYFSCPPWFSSGAKKFIKRILDPNPDTRITIAEILEDEWFKKDYKPPRFEQGEDVSLDDIDAAFNDSEDRLVAEKREKPESMNAFALISRSQGFNLGNLFEKEMMMKLKGDKSGRKGHLSVATEVFEVAPSLHMVELRKTGGDTLEFHSFYKNFSSELKDIVWKAESDANNKQTNK

SEQ ID NO: 9330 - protein, 395 aa, Zea mays
EFPGEKPLLSHLRFFPWVVNEVYFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQDALSEMWELEAASRAAMENGMEEGLGDSTDEPPIDFPQELRMEVDRQPVQPAIHAPGVTGRRREDQMVPSMTSSFIRAETELTADFGHTSEDSRPEVPSNIHHLQARPEREETVDGGTGNAVRVHGNHHQQNLQNNMHRVLGIAPSISEASSSWTGRDGGVVPVWSPPAASGHSDSYAADEADISSRGYLDRHPQSHTMMNWSQLSQSLTTGWEVDN

SEQ ID NO: 9331 - protein, 374 aa, Geobacter metallireducens
MRKVFDETKIHHLTLRNRLVRSATWEGMCRAGGHPTEKLAAYYGTLARGGVGLIISGYAFVRPDGKQLPGQLGIHEDSFAPEARLLTEAVHREGGKICLQLVHCGGQTTARAAGAQPVAPTAVQIDQYPELPRELPEAEIADLVAAFAAGAVRAREWGFDAVQLHAAHGYLINQFLSPLTNRRTDRYGGSLENRCRFLLEISHAVRAAVGKDFPVMVKLNGSDNLNGGLDLEEAVLVARMLDEEGIDAIEVSGGTPASGGQTPVRQGIETREQEAYNLPLAYRIKQVVSCPVMVVGGFRTFELVEGVIRREEADFVSLSRPLIREPNLPRRWEEGDESRARCISCNGCFKPGMKEGGIYCVVDKVERESRAFSL

SEQ ID NO: 9332 - protein, 674 aa, Unknown
  Synechococcus sp. CC9605
MCGIGGVFNADRQQTVDRQLLVNMAAIQAHRGPDGFGVEVLDQAGVGFCHARLSIIDLNESRARQPFLTDDGEVLMAHNGEFYDFQRIRADLTAQGVRFSSKSDSEILLRLYQRQGLEATLPLLRGEFAFALFDRSEDCLYLVRDRFGIKPQYWAITPEGLVFGSELKVLFAHPAVERRFTSEGLFHQLMQTMVPGTTAFAGVHQVKPGHVLKVQRVNGHLEVSESTYWDVDFPRKDERDPKRTEADYIAAVRAALLEAVELRMVADVPVGCYLSGGIDSCSILGLASAVSQAPVKAFTIGFDDARYDESPIAREMAEATGAEQDLMRLSGQELYGHMERTIWHAERTIYNTLAVAKFLMSRHVNDVDYKVVMTGEGSDELFGGYPAFRRDMFLHGLDDLPQEERASWESLLQQSNALVKGAMLAENQVDDPDLDAVVGFTPSCLQPWLACAPLVPELLAESHAAALEGYSPGKAIAEQLDADQLDGRHALDKAQYVWIKTMLEGQILTWGGDRVDMANSMEARPAFLDHHLAAVAVQVPPELRIKGKTEKYVLREAMAGLLPEVLYRREKFAFMAPPAHTEPEKWGQMKQLADDYLSDEAIDSAGLLSKAGVLALFERHEDPATTDAERVQMDAVINHLLGVQMLHRMFVAEDVPALARREADRLGWRVLMPV

SEQ ID NO: 9333 - protein, 552 aa, Magnetospirillum magnetotacticum
MAAKEVKFSTDARTRMLRGVDILADAVKVTLGPKGRNVVIEKSFGAPRITKDGVTVAKEIELADKFENMGAQMVREVASKTADLAGDGTTTATVLAQAIVREGVKAVAAGLNPMDLKRGVDLAVAAVVADVKSRSRKVATNAEIAQVGTISANGEKEIGDMIAKAMEKVGNEGVITVEEAKGLDTELDVVEGMQFDRGYTSPYFVTNAEKMTVELDNPYILLHEKKLSGLQPLLPVLEQVVQSGRPLVIIAEDIEGEALATLVVNKLRGGLKVAAVKAPGFGDRRKAMLEDIAILTGGQVISEDLGIKLESVNLEMLGTSKRITITKEDTTIVDGSGDKSAIDARCKQIRAQVEETTSDYDREKLQERLAKLAGGVAVIKVGGASEIEVKERKDRVDDALHATRAAVEEGIVPGGGVALLHAVKALEGLKSGNADQEVGISIVRRALQAPVRQIAENAGHDGAVVAGKIGESKDLAFGFDAQTGVYTDMIKAGIIDPTKVVRTALQDAASVAGLLITTEAMIAERPKKDAGGMPGGDMGGMGGMGGMGGMDF

SEQ ID NO: 9334 - protein, 180 aa, Triticum aestivum
  misc_feature (99)..(99): Xaa can be any naturally occurring amino acid
  misc_feature (114)..(114): Xaa can be any naturally occurring amino acid
  misc_feature (124)..(124): Xaa can be any naturally occurring amino acid
  misc_feature (132)..(132): Xaa can be any naturally occurring amino acid
  misc_feature (134)..(134): Xaa can be any naturally occurring amino acid
  misc_feature (139)..(139): Xaa can be any naturally occurring amino acid
  misc_feature (141)..(141): Xaa can be any naturally occurring amino acid
  misc_feature (146)..(146): Xaa can be any naturally occurring amino acid
  misc_feature (148)..(148): Xaa can be any naturally occurring amino acid
  misc_feature (157)..(158): Xaa can be any naturally occurring amino acid
  misc_feature (161)..(161): Xaa can be any naturally occurring amino acid
MEGRMFGLETPLMTALQHLLDVPDSESGGAGNAGGERQGPTRAYVRDARAMAATPADVKELPGAYAFVVDMPGLGSGDIKVQVEDERALVISGERRREXKEDARYLRMERRMGXKLMPKFVLPXENAHMEKXSXAVCRXRXAQPSXSXKLPPAPKPXXAPXTIQSRSPLKNESICPVQSK

SEQ ID NO: 9335 - protein, 731 aa, Corynebacterium glutamicum
MTVDPASHITIPEADLARLRHCNHHDPHGFYGWHETEAGSVIRTRQVGATQVNLLIDDTSHVMTPIGDDIFAIDLGHRERADYRLEVTWPDQEPQVKADPYYFLPTVGEMDIYLFSEGRHERLWEILGANIKTYQTALGTVRGTAFTVWAPNAIGCAVVGGFNGWNASQHPMRSMGGSGLWELFIPGIEEGEVYKFAVQTREGQRRDKADPMARRAELAPATGSIVASSEYQWQDSEWLRERSQTDLASKPMSVYEVHLGSWRWGKNYEDLATELVDYVADLGYTHVEFLPVAEHPFGGSWGYQVTGYYAPTSRWGTPDQFRALVDAFHARGIGVIMDWVPAHFPKDDWALARFDGEALYEHPDWRRGEQKDWGTLVFDFGRNEVRNFLVANALYWIEEFHIDGLRVDAVASMLYLDYSREHGEWEPNIYGGRENLEAVQFLQEMNATVLRLHPGALTIAEESTSWPGVTAPTWDGGLGFSLKWNMGWMHDTLEYFSKNPVHRAFHHSELTFSLVYAFSERFVLPISHDEVVHGKGSLWDRMPGDTWNKAAGLRTFLAYMWSHPGKKLLFMGQEFGQREEWAEGQGLPWDIVDGWQGEYHEAIRTLTRSLNGVYSDSPALHTQDFTGEGFTWNKGDDATNNILAFTRFGSDGSQMLCVFNLSGTSQPEYQLGVAAGGEWKLVLNTDDAEFLGAENDIATSVQAAATPRDNFAYSLSLHVPAMSAQFYSLQK

SEQ ID NO: 9336 - protein, 374 aa, Loeseneriella africana
ALSIAGAVQSQKLAVRAISQLQSLPGGDIKLLCDTAVENVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLDKHVLKTQTLLCDMLLRESPTGIVTQSPSIMDLVKCDGAALYYQANYYPLGVTPTEAQIKDIVEWLLAFHGDSTGLSTDSLADAGYPGATSLGDAVCGMAVAYITNKDFLFWFRSHTAKEIKWGGAKHHPEDKDDGQRMHPRSSFKAFLEVVKSRSLPWEN

SEQ ID NO: 9337 - protein, 363 aa, Loeseneriella africana
QSQKLAVRAISQLQSLPGGDIKLLCDTAVENVRNLTGYDRVMVYKFHEDEHGEVVAESRRPDLEPYIGLHYPATDIPQASRFLFKQNRVRIIVDCHASPVIVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATSLGDAVCGMAVAYITNKDFLFWFRSHTAKEIKWGGAKHHPEDKDDGQRMHPRSSFKAFLEVVKSRSLP

SEQ ID NO: 9338 - protein, 254 aa, Brassica rapa
MGRGRVEMKRIENKINRQVTFSKRRAGLLKKAHEISILCDAEVSLIVFSHKGKLFEYSSESCMEKVLERYERYSYAEKQLKAPDSHVNAQTNWSMEYSRLKAKIELLERNQRHYLGEDLESISIKELQNLEQQLDTSLKHIRSRKNQLMHESLNHLQRKEKEILEENSMLTKQIKERESILRTHQNQSEQQNRSHHVAPQPQPQLNPYMISHQASPFLNMGGMYQGEDPTAVRRNRLDLTLEPIYNCNLGYFAA

SEQ ID NO: 9339 - protein, 365 aa, Loeseneriella africana
AVQSQKLAVRAISQLQSLPGGDIKLLCDTAVENVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLEKHVLKTQTLLCGMLLRESPTGIVTQSPSIMDLVKCDGAALYYQANYYPLGVTPTEAQIKDIVEWLLAFHGDSTGLSTDSLADAGYPGATSLGDAVCGMAVAYITNKDFLFWFRSHTAKEIKWGGAKHHPEDKDDGQRMHPRSSFKAFLEVVKSRSLP

SEQ ID NO: 9340 - protein, 612 aa, Bradyrhizobium japonicum
MCGIAGIVNLRGSAVEPDDISRLTGLIAHRGPFGQGTWFSADRSLAFGHRRLAIIDPGEGGYQPMRSADGRHVIVFNGEIYNFLELRRELEAQGVVFRSQSDTEVILAAWQAWREDMLPRFNGMWALAIFDTATGELFLARDRFGIKPLLYAVSPERFIFASEQRALVRSGLIDASVDVEVARRLLLDAFGIEGSERTLFRQVRRLQGGHCMWLRQGKVSVRRWWRTVDHLPPVPGTEAEQVARFRELFQDAVALRMRSDVPIGTCLSGGFDSSAVICTMAAHEKAGMGPRDSTAWRHAFVATFPGALNDERPMAEEAAAWAEVAPTFLEIGQADALIDLDQILDDLDDVYIALPSAIWLIYRQLRRQDVTVSLDGHGADELMGGYLQQGQALAFRIRNAAEDFASRSALARRSVDVLRMLALKRRGVYFLRGGLRDLPASLPLVAEDDVLPREWGGLNRRLYRMFHSTVLPTILRNFDRLSMAHGVEVRMPFMDWRLVTYTMALPESSKSSEGYTKAVARRAMANLMPESIRTARRKVGFNSPMPEWLNGPLAGWTADLLDRKVPAFAELVDEAALRTTVSRLTASKSWDWEAVGRIWPYLNMKWMLARYA

SEQ ID NO: 9341 - protein, 501 aa, Oryza sativa
MDGRSILMGRYEVGKQLGQGTFAKVYYARNLTTGQAVAIKMINKDKVMKVGLMEQIKREISIMRLVKHPNVLQLFEVMASKSKIYFVLEYAKGGELFNKIAKEGKLSEDSARRYFHQLINAVDYCHSRGVYHRDLKPENLLLDENENLKVSDFGLSALAESKRQDGLLHTTCGTPAYVAPEVLSRKGYDGAKADVWSCGVILFVLVAGYLPFHDPNLIEMYRKICRADFRCPRYFSAELKDLIHKILDSDPSTRISIPRIKRSTWYRKPVEINAKNSEAATTNSISSGVATTSGSAECSTSEENQGSLSLPNLNAFDIISLSTGFNLSGFFEDTHGHQEERFTTRQPVTTVLGKLKELAKRLKLKVKKKDNGVLRLAAPKEGKKGFLELDAEIFEVTPSFLLVELKKTNGDTMEYRKLVKEDIRPALKDIVWVWQGDEHLNSQSILQGEQQQSPLPPELPQDQLQPSLPQQEKQDMPEPPLLPQVPQEEVQTSIPAEQTKN

SEQ ID NO: 9342 - protein, 336 aa, Xanthomonas axonopodis
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 9343 - protein, 280 aa, Listeria innocua
MTLSFSDTYRLNNGIEMPRHGFGVYKLTDEQRMRTALETAVDVGYRLFDTASFYHNEKELGDFFASSGLKRDEFFVTTKMWNTEQGYDETLRAFEKSQKKLQLDQVDLYLVHWPKQDTFFETWRAVEKLYDEGLVRAIGVSNFEAHHLDRLRTSANVLPVVDQLETHPHFPNQLLHRYLEELHIVHQAWSPLGRGGVLQEQILIDLAKKHGKSPAQIVLRWHLQNNISIIPKSETPSRIRENADIYDFELTEADMRQVERLNNGERVSHAPDVMYVRSEI

SEQ ID NO: 9344 - protein, 364 aa, Maytenus fournieri
VQSQKLAVRAISQLQSLPGGDVKLLCETVVESVKDLTGYDRVMVYKFHDDEHGEVVAERKRPDLEPYIGLHYPATDIPQASRFLFKQNRVRMIVDCHALPVRVIQDDGLMQPLCLVGSTLRAPHGCHAQYMENMGSIASLAMAVIINGNDEEVIGGRNPTRLWGLVVCHHTSARCIPFALRYACEFLMPAFGLQLNMELQLAAQLLEKHVLKTQTLLCDMLLRDSPTGIVTQSPSIMDLVKCDGAALYYQGSYYPLGVTPTEAQIKDIVEWLLAFHGDSTGLSTDSLADAGYPGAALLGDAVCGMAVAYITNRDFLFWFRSHTAKEIKWGGAKHHPEDKDDGQRMHPRSSFKAFLEVVKSRSMP

SEQ ID NO: 9345 - protein, 363 aa, Maytenus fournieri
QSQKLAVRAISQLQSLPGGDVKLLCETVVESVKDLTGYDRVMVYKFHDDEHGEVVAERKRPDLEPYIGLHYPATDIPQASRFLFKQNRVRMIVDCHALPVRVIQDDGLMQPLCLVGSTLRAPHGCHAQYMENMGSIASLAMAVIINGNDEEVIGGRNPTRLWGLVVCHHTSARCIPFPLRYACEFLMQAFGLQLNMELQLAAQLLEKHVLKTQTLLCDMLLRDSPTGIVTQSPSIMDLVKCDGAALYYQGSYYPLGVTPTEAQIKDIVEWLLAFHGDSTGLSTDSLADAGYPGAALLGDAVCGMAVAYITNRDFLFWFRSHTAKEIKWGGAKHHPEDKDDGQRMHPRSSFKAFLEVVKSRSMP

SEQ ID NO: 9346 - protein, 202 aa, Saccharophagus degradans
MEVVFMNLQTLNPWNWFKHEEAAKQHAAAPAIHSAENSETSAPQLNSLIQLHQQMDKLFDDVFSSFGFPSLGARFADANLLTNRANSLLGGYRPTVDVSGDKTHYHISLDVPGLSESDISIDVSNDVLTIRGSKEEKAEQNEKHVYRMERRYGSFQRTLSLPSDANTDDITAQLKDGVLNLVIAKKDVPPEDVKRIPINSVH

SEQ ID NO: 9347 - protein, 352 aa, Cytophaga hutchinsonii
MAFIDVVLQRPSYGWMDENGNLVKPAGKQLFAEFCSRINIFKSRKNWIALAGWFWVLCLLPFLFLFLFTYFNWKLLFICIFYSMVVMGTHGTIWYHRYGTHRAFIFRNAFWRFITQNLVVKLIPEEIYIVSHHVHHSKSDQPGDPYNASAGFLYCFLADTNHQPIAKDLDEKNYARAAVLVKHTGIKINSYEQYQKWGSIADPGRTAALWIANWVCWYGIFYLIGGHALACALFSGALIWVIGVRTFNYNGHGKGTESHRDGLDFNRKDLSVNQYRPGLLAGEWHNNHHMYPGSARSGFLPYQIDFAWYYIYVLYKIGAVSSYHDSKKQFYENYYVPYKNASKKESVKDFVD

SEQ ID NO: 9348 - protein, 494 aa, Triticum aestivum
MSYNKTASITAETINPKVKIFDYEPCGEIARHAERLEQEMEKSPGSRPFPEITYCNLGNPQALGQRPITFFREVLSLCDNPALLRRDETRMLFSPCAINRARKIIESMPGRNSGAYTNSQGIRSLREAVASGIAARDGFPSRPEDIFLTDGASSAINLSMQILIRSQEDGVLCPLPEYPLYSASIILHGGTMVPYNLSEDGDWGLEIFEVKRCLEEARIAGLTVRAMVIINPGNPTGQVLSVTNQEEIVEFCRKEGLVMLADEVYQDNVYVEDRKFHSFKKVARSLGYDENDISIVSFHSVSMGFSGECGRRGGYMEICGFGDDVMGEIRKVASVTLCPNIGGQILTSLAMDPPKLGDGCFENFMAEKEDIRLSLAKRAKTLAGAFSSLEGMTCNRVEGAIYAFPRIHLPAAAIKAAKAEGMSPDLFYACRLLDATGIAVVPGSGFHQVSGRNKATGTWHIRCTILPGEDKIKVMIPRLKEFHESFMNEFRDRS

SEQ ID NO: 9349 - protein, 286 aa, Lactobacillus sakei
MQKLSALTAPMALSNGVTIPGLGYGTYQTPNEETKKAVLEALSVGYRHIDTAAVYGNEQGVGDALKESDIAREDIFVTSKLWNTERGYDATKAAFAKTIATLGVDYLDLYLIHWPANTKQFGAKAAELNAETWRAMEDLYNEGKIRAIGVSNFMPHHLDELMKTAVIKPMVDQIEVHPGWPQAEAVRYNQAHDILVEAWAPLGEASALSNETIAAIATKHGKTAAQVCLRWGIQQGVLPLPKSTHQERMAQNTDIFDFELTDAEMTQISALENLGGQCMVPDEVDF

SEQ ID NO: 9350 - protein, 445 aa, Bradyrhizobium japonicum
MRKTLLFPLGALTGACLTLLVASPHGGVWAARAAAGADDAYSQLNLFGEVFERVKASYVEKPDNAKLIEGAITGMVTSLDPHSRYMNDKAWTEMQETTSGEFGGLGIEVTMEEGLVKVVSPIDDTPASKAGIMSGDLISKIDGDAVQGMTLEQAVNKMKGPVDTKTKLTIVRKGADAPLDIAITREIIHVRPVRFHVENGDIGYIRVTSFNEQTTDGLKKAIAAISREIPQEKLAGYVMDLRNNPGGLLDQAVSVSSAFLQRGEVVSTRGRNPEETQRFTAHGGDLTKGKPLVVLVNGGSASASEIVAGALHDHKRATIIGTRSFGKGSVQTIIPLGAGNGALALTTARYYTPSGRSIQAQGIAPDIEILQDVPPELKGRMDTMAESQMRGHLQAADGTEQTGSQSYVPPKEEDDKALHAAYDFLHGVTANAVAAKPAPKAAVPN

SEQ ID NO: 9351 - protein, 726 aa, Xanthomonas campestris
MKSPLPWLKRRLSGRADSEHAQNLIRIIITTLFISYLGWRYQHTHGDTLMATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVLAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 9352 - protein, 358 aa, Maytenus undata
SQKLAVRAISQLQSLPGGDIKLLCDTVVESVRDLTGYDRVMVYKFHEDEHGEVMAESKRPDLEPYIGLHYPASDIPQASRFLFKQNRVRMIVDCHASPVLVIQDDRLMQPLCLVGSTLRAPHGCHAQYMENMGSIASLAMAVIINVNDGEGIGGRNPTRLWGLVVCHHTSARCIPFPLRYACEFLMQAFGLQLNMELQLAAQLLEKHVLKTQTLLCDMLLRDSPTGIVTQSPSIMDLVKCDGAALYYQGNYYPLGVTPTEAQIKDIVEWLLAFHGDSTGLSTDSLADAGYPGAALLGDAVCGMAVAYITNRDFLFWFRSHTAKEIKWGGAKHHPEDKDDGQRMHPRSSFKAFLEVVKS

SEQ ID NO: 9353 - protein, 544 aa, Chlamydia muridarum
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVDQIKKISKPVQHHKEIAQVATISANNDAEIGNLIAEAMEKVGKNGSITVEEAKGFETVLDVVEGMNFNRGYLSSYFATNPETQECVLEDALVLIYDKKISGIKDFLPVLQQVAESGRPLLIIAEDIEGEALATLVVNRIRGGFRVCAVKAPGFGDRRKAMLEDIAILTGGQLISEELGMKLENASLAMLGKAKKVIVSKEDTTIVEGMGEKEALDARCESIKKQIEDSTSDYDKEKLQERLAKLSGGVAVIRVGAATENEMKEKKDRVDDAQHATIAAVEEGILPGGGTALIRCIPTLEAFLPMLTNEDERIGARIVLKALSAPLKQIAANAGKEGAIIFQQVMSRSANEGYDALRDAYTDMIEAGILDPAKVTRSALESAASVAGLLLTTEALIAEIPEEKPAAAPAMPGAGMDY

SEQ ID NO: 9354 - protein, 245 aa, Maytenus undata
ALSIAGAVQSQKLAVRAISQLQSLPGGDIKLLCDTVVESVRDLTGYDRVMVYKFHEDEHGEVMAESKRPDLEPYIGLHYPASDIPQASRFLFKQNRVRMIVYCHASPVLVIQDDRLMQPLCLVGSTLRAPHGCHAQYMENMGSIASLAMAVIINVNDGEGIGGRNPTRLWGLVVCHHTSARCIPFPLRYACEFLMQAFGLQLNMELQLAAQLLEKHVLKTQTLLCDMLLRDSPTGIVTQSPSIMD

SEQ ID NO: 9355 - protein, 217 aa, Cryptomeria japonica
MVRGKVNLQRIQNPVNRRVTFSKRKAGLLKKAGELSVLCEAEICSIIFSPTGKLFEFASHSMNRIIGKYKKNCASIGHHIQLQEHLETLRMELENLRIETTHLEKTCKHMNGEDLDFLNFKELQKLEKKMSLSARKIHLRKDKILVENVGSLKSKEKLLELENAEMDKKIGRSHKACHLNINMMDEVNSKLETEASTRQDCLKLTLISRNFHDDNFC

SEQ ID NO: 9356 - protein, 245 aa, Mortonia greggii
ALSIAGAVQSQKLAVRAISQLQSLPGGDIKLLCDAVVENVRNLTGYDRVMVYKFHEDEHGEVVAESKRPDLEPYIGLHYPATDIPQASRFLFKQNRMRMIVDCHSTPVSVIQDDGLMQPLCLVGSTLRAPHGCHAQYMANMGSIASLAMAVIINGNDEDGIGGRNTTRLWGLVVCHHTSARCIPFPLRYACEFLMQAFGLQLNMELQLASQLLEKHVLKTQTLLCDMLLRDSPTGIVTQSPSIMD

SEQ ID NO: 9357 - protein, 283 aa, Bacteroides fragilis
MDFKELNNGVKMPIQGFGVFQIPDATECERVVTDALAVGYRLIDTASVYGNERAVGTAIRKSGIPREELFITTKAWISEMGYERTLRALDASLARLGLDYLDLYLIHMPFGDYYGAWRAMEKLYAKGRVRAIGVCNFEPDRLLDLCHNANVIPAVNQIEVHPYTPQTDAIRTMQELGIQAEAWGPLAEGRNGLFTDDILTGIARKYDKSAAQVVLRWHLQRGVVAIPKSVHRQRMQENFNIGDFMLTPEDMAAIASMNTGYNTILDLRAPEEVQRLYGIECPA

SEQ ID NO: 9358 - protein, 245 aa, Mortonia greggii
ALSIAGAVQSQKLAVRAISQLQSLPGGDIKLLCDAVVENVRNLTGYDRVMVYKFHEDEHGEVVAESKRPDLEPYIGLHYPATDIPQASRFLFKQNRVRMIVDCHSTPVSVIQDDGLMQPLCLVGSTLRAPHGCHAQYMANMGSIASLAMAVIINGNDEDGIGGRNTTRLWGLVVCHHTSARCIPFPLRYACEFLMQAFGLQLNMELQLASQLLEKHVLKTQTLLCDMLLRDSPTGIVTQSPSIMD

SEQ ID NO: 9359 - protein, 226 aa, Zea mays
MSSSTASWSRYGALPTSPPAPQLKPEDVAAAGGDAAPSSSSAAATAAEAGVAFFSRARAFAGAAAGRPRAWREVLDPTAFSCPDSCGEARARARRNLAYFRANYALAALALVFLGLVYRPASMLAFLALFVAWLGLYFGRGGGEPLVCLRREVDDRVVLAALSAATVLAVALTRAGLNLLVSLVVAAAVIGAHAAFRVNLYLDESDAFDVAGASFTDTAYGYALPS

SEQ ID NO: 9360 - protein, 830 aa, Hordeum vulgare
RAPHGCHAQYMANMGSIASLVMSVTVNEDDDEDGDTGSDQQPKGRKLWGLVVCHHTSPRFVPFPLRYACEFLLQVFGIQLNKEVELASQAKERHILRTQTLLCDMLLGDAPVGIFTQSPNVMDLVKCDGAALCYQNQIMVLGSAPSEGEIKKIAAWLLECHDGSTGLSTDSLLEAGYPGASALGEVVCGMAAIKISSKGFIFWFRSHTAKEIKWSGAKHEPGDADDNGRRMHPRSSFRAFLEVVKWRSVPWEDVEMDAIHSLQLILRGSLQDEDANDNNVGSIVEAPSDDVRKIQGLLELRVVTNEMVRLIETATAPILAVDIVGSINGWNGKVAEITGLPTTEAIGMLLVDLVEGDSVEVIKQMLNSAMQGTEEQNFEIKLKTFHQQEGNGPVVLMVNACCSRDLSDKVVGVCFVAQDLTGHKMVMDKYTQIQGDYVAIVKNPNELIPPIFMINDLGSCLEWNEAMQKITGIKREDAIDKLLIGEVFTLHDYGCRVKDQATITKLSILMNTVISGQEPEKLAFGFFSTDGKYMESLLTANKRTDAEGKITGALCFLHVPSPELQHALQVQKMSEQAAARSFKELTYIRQELKNPLNGMQFTRKLLEPSDLTEEQRQLFASNVLCQEQLKKILHDNDLEGIEQCYMEMNTVEFNLEEALNTVLMQGMSLSKEKQISLDRDWPVEVSSMYLYGDDLRLQQVLADYLACTLQFTRPAEGPIVLQVIPKKEHIGSGMQIAHLEFRVVHPAPGVPEALIQEMFRHGPGVSREGLGLHISQKLVKTMSGTVQYLREAESSSFIVLVEFPVAQLNSKRSKPSTSKWSKPSTSKSNF

SEQ ID NO: 9361 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVTFLAPDRTPLAHAGPSMLNQAPTGNGSQMLQRTGSDATRYLLPVFGRHRNLAGDLIPDESDRLLGWVELELSHNSMLLRGYRSLFASLMLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGLELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 9362 - protein, 773 aa, Azoarcus evansii
MRIVCIGGGPAGLYFAILMKKLNPVHEIRVVERNRAYDTFGWGVVFSDATMDNMREWDPETADAIQVAFNHWDDIELNFKGRTIRSGGHGFVGIGRKKMLNILQERCEALGVELEFDREVESDAEFPDADLIIASDGINSRIRNKYAEVFRPDIVTRPNRYIWLGTTKLFDAFTFYFEKTEHGWFQAHVYKFDDTTTTFIVECPEHVWKAHGLDSADQEQSIAFCEELFGKHLDGHRLMTNSRHLRGSAWLNFQRVKCEQWHHDNGRSHVVLMGDAVHTAHFAIGSGTKLALEDAIELTRLFRDEGDTREHIPTVLERYQAARNIDVLRLQNAAWNAMEWFEVCGARYCDTLEPEQFMYSMLTRSQRISHENLRLRDAAWLEGYERWLAAKSGVPVADDAVPPPMFTPFKLRGLTLANRIVMSPMAMYSAEDGAPNDFHLVHFGSRALGGAGLLYTEMTCVSPDARITPGCAGMYKPEHVNAWKRIVDFVHDNSDARIGMQLGHAGRKGATKVAWEGIDEPLEAGTWELISASAQPYLPHSQVPRAMTRDDMERVRNDFVRATRMAAEAGFDILELHCAHGYLLSSFLSPLTNRRTDEFGGGVENRARFPLEVFKAMRVLWPTNRPMSVRLSCHDWFPGGNTGDDAVAIARLFKEAGADIIDCSSGQVWKGDQPVYGRMYQTPFADRIRNEVGIPTLAVGAISEADHANSIIAAGRADLVALARPHLADPAWTLHEAAKIGFGGVAWPRQYRSARGQYETNLQRAAAAATSAR

SEQ ID NO: 9363 - protein, 469 aa, Oryza sativa
  misc_feature (205)..(205): Xaa can be any naturally occurring amino acid
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSHGDQVPRXLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 9364 - protein, 213 aa, Cytophaga hutchinsonii
MIHIETLTFNPLQENTYIVYDEAGDCMIVDPGCYEAYEQKELTDFIAKKKLTVRLLVNTHGHIDHVLGNYFVKETYKVPFEIFHLDAATLQAVGAYAPNYGFFQYTPATPDRLLKEGDAVIVGSMKFDILFVPGHAPGHIAFVNTAEKICLSGDVLFRSSIGRADLPGGNYDTLIHSIKTKLFLLPDDTIVYPGHGPTTTIQFEKKHNPYCAL

SEQ ID NO: 9365 - protein, 480 aa, Glycine max
SPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMELGPPISKEVQLISFHSVSKGYYGECGQRGGYFEMTNIPPETVDEIYKVASISLSPNVPAQIFMGVMLNPPQPGDISYDKFVRESTGILESLRRRARIMTDGFNSCRNVVCNFTEGAMYSFPQIRLPPRALEAAKQAGKVPDVYYCLKLLEATGISTVPGSGFGQKEGVFHLRTTILPAEEDMPDIMDSFKKFNDEFMEQYEDDRGYSRL

SEQ ID NO: 9366 - protein, 485 aa, Debaryomyces hansenii
MAPVYTNSNGCPIPEPFATQRVGQHGPLLLQDFNLIDSLAHFDRERIPERVVHAKGSGAYGYFEVTDDISDVCSAAFLDTIGKKTKVLTRFSTVGGESGSADSARDPRGFSTKLYTEEGNLDLVYNNTPVFFIRDPSKFPHFIHTQKRNPETHLKDPTMFWDYLTSNQESIHQVMTLFSDRGTPASYREMNGYSGHTYKWSNKKGEWYYVQVHFISDQGVKTLTNEEAGELAGSNPDFAQEDLFKEIAKGNAPSWTCYIQTMTQEQAKKAPFSVFDLTKVWPHKDYPMRRFGKLVLNENPKNYFAEIEQAAFAPAHTVPYMEASADPVLQSRLFSYADTHRHRLGTNYTQIPVNCPITGRVFNPHMRDGGMNVNGNLGSHPNYLATSKPVEFKNFSIQEEQEVWEGAACPFHWKCTDKDYSQATALYNVLAKYPNQQKNLAHNVAVHVSGAETHIQDKVFDMFAKVHPELSANIKKEALQLSPRK

SEQ ID NO: 9367 - protein, 891 aa, Schizosaccharomyces pombe
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKDAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFERQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQNSAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLMLVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 9368 - protein, 443 aa, Brassica napus
  misc_feature (22)..(22): Xaa can be any naturally occurring amino acid
  misc_feature (41)..(41): Xaa can be any naturally occurring amino acid
RKRTTPASRTRVGNYEMGRTLXEGSFAKVKYARNTVTVDIXSAAIKILDRDKILRHKMVEQLKREISTMKLIKHPNVVEIIEVMASKTKIYIVLELVNGGELFDKIAQQGKLKEDEARRYVHQLINAVDYCHSRGVIHSDLKPENLIPDANGILKVSDFGLSAFSLQVRGDGLLHTACGTPNYVAPEVLSDKGYDGAAADVWSYGIILFVLMAGYLPFDEPNLMTLYKRICKAEFSCPSWFSPGAKEVIKRILDPSPITRISIAELLEDEWFKQGYKPPSFGQDDEDITIDDVDAAFSNSKESLVTEKKAKPESMNAFELISSSNSLENLFEKQAQLVKKETRFTSQRPASEIMSKMEETAKPLGFNVRKDKYKIKMKGDKSGRKGQLSVATEVFEVAPSLHVVELRKTGGDTLEFHKFYKNFSSGLKDVVWNTDGAPEEHKA

SEQ ID NO: 9369 - protein, 370 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEFFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKALNKFRTKASENAAY

SEQ ID NO: 9370 - protein, 96 aa, Brassica napus
  misc_feature (91)..(92): Xaa can be any naturally occurring amino acid
MASSMLSSAAVVTSPAQAAMVAPFTGLKSSAAFPVTRKSNTDITSIASNGGRVSCMKVWPPVGKKKFETLSYLPDLTDVELAKEVDYLLRXXWIPC

SEQ ID NO: 9371 - protein, 651 aa, Chlamydophila abortus
MIKILRLCALVLTCFPSFSFASELLHEEDIRKTVDKLIEYHVDIQDISSDILVRSLLGYSQSFDPHKAYLTEQEINNFIYSADIKKRLLKNYKTNNFSIYQNLNRVIKESITRARQWRAEWLSDPEALVKEAASHSLMKKPNQWARSMEEAKERQRALLLSYISVYLSDSAKDRYLGKEASLTQLCARQLEAYENPYLGINDYGEPMLPQEESHHFHVRVVKAMAHSLDAHTTYFSKEEALAMRIQLEKGMCGIGVILKEDIDGVIVKEIIPGGPAEKTGELHVDDVIYRVDGRSIENLPFRAVLDCLRGSQGSEVILDVHSKDGNRTVKLKREKISLDDRRVDVSYEAYGDGIIGKITLHSFYEGDNQISSEQDLKRAIQSLQEKNLLGLVLDIRENTGGFLSQAIKVSGLFMTNGVVVVSRYADGSIKRYRTVSPKKFYDGPLTILVSKSSASAAEIVAQTLQDYGVAIIVGDEQTYGKGTIQHQTITADANTEGFFKVTVGKYYSPSGKSTQLRGVRSDIHVASRYFAEPLGERYLEHPLPSDSCDNVMNDNLGDLDSHMRPWFQKYYIPNLQKEETVWKEMLPQLTENSRQRLSENKNYKIFLEEVKDPSEAIRPFGSNDLQMEESVNILKDMILLRDRKAAVSLGG

SEQ ID NO: 9372 - protein, 312 aa, Ostreococcus tauri
MVEKHVLSSKRSLGRFERYARAHCLNSADTSCSSLGVLSAKFMKLLSETENGILDLNHAATSLSAQKRRVYDITNVLEGIGLVSKLSKSKVALRRVDEDFVETTSGQHKEHKSLSRTVNIESSQTLPLASEDDASLHIETIRSFIRSTGIFISQADIIEQHALSSDMLIAVRAPTGAALLLPSPFTQERSPPHYRLFLRSNENSSAGVEVFTLGRRSGTCDAHDVIQILNGFSSLCREAQRAVWLLNSCDVLYFDINKDHVPVSFATILEFDNVHHNVTLIRQLPTFFLGVLFCHFLQVGNVFGTYSQGEKF

SEQ ID NO: 9373 - protein, 95 aa, Brassica oleracea
MGRGRVEMKRIENKINRQVTFSKRRAGLLKKAHEISILCDAEVSLIVFSHKGKLFEYSSESCMEKVLEHYERYSYAEKQLKVPDSHVNAQTNWSM

SEQ ID NO: 9374 - protein, 245 aa, Paxistima canbyi
ALSIAGAVQSQKLAVRAISQLQSLPGGDIKLLCDTVVESVRDLTGYDRVMVYKFHEDEHGEVVAESKRPDLEPYIGLHYPATDIPQASRFLFKQNRVRTIVDCHASPVRVIQDDGLMQPLCLVGSTLRAPHGCHAQYMENMGSIASLAMAVIINGNDEEVIGGRNATRLWGLVVCHHTSARCIPFPLRYACEFLMQAFGLQLNMELQLAAQLSEKHVWKTRTLLCDMLLRDSPPAIVTQSPSIMD

SEQ ID NO: 9375 - protein, 160 aa, Triticum aestivum
  misc_feature (52)..(52): Xaa can be any naturally occurring amino acid
MSLIPRGKAFDPFSLDLSDPFDGFPFGSGGISSFFPSFPRASSETAAFAGAXGDFDWKETPEAHVFKADVPGLKKEEVKVEVEDGNVLQISGERNKEQEEKTGTWHRVERSSGKFLRRFRLPDNAKADQIKAAMENGVLTVTVPKKEVKEPEVKSIQISG

SEQ ID NO: 9376 - protein, 95 aa, Brassica oleracea
MGRGRVEMKRIESKINRQVTFSKRRAGLLKKAHEISILCDAEVSLIVFSHKGKLFEYSSESCMEKVLEHYERYSYAEKQLKVPDSHVNAQTNWSV

SEQ ID NO: 9377 - protein, 245 aa, Paxistima myrsinites
ALSIAGAVQSQKLAVRAISQLQSLPGGDIKLLCDTVVESVRDLTGYDRVMVYKFHEDEHGEVVAESKRPDLEPYIGLHYPATDIPQASRFLFKQNRVRTIVDCHASPVRVIQDDGLMQPLCLVGSTLRAPHGCHAQYMENMGSIASLAMAVIINGNDEEIIGGRNATRLWGLVVCHNTSARCIPFPLRYACEYLLQLFGLQLNMELQLAAPLSKKHVLKTQTILYDMLLHDSPTGIVTQSPSIMD

SEQ ID NO: 9378 - protein, 209 aa, Sulfolobus solfataricus
MIVKNFITGPLATNSYLVIAGKEGVIIDAGGDMSELIQTVRKEKINIRYIIATHGHFDHIMGVNQIKRDFPSSTFLINEKDLGLLKRASSMAQSFLNLLISDVTKPDGFVKEGDEIELGGEKLKIIETPGHTMGSICIIANGYIFTGDTLFYGTVGRTDLGGSEKLLRESLEKLKKLPDEIIVYPGHGPFTVLGYEKVKNPFLTMDILP

SEQ ID NO: 9379 - protein, 481 aa, Colwellia psychrerythraea
MKKKLTTNAGCPVANNQNVMTAGPRGPQLLQDVWFLEKLAHFDREVIPERRMHAKGSGAYGTFTVTHDITQYTRAKIFSEVGKKTEMFARFTTVAGERGAADAERDIRGFALKFYTEEGNWDLVGNNTPVFFLRDPLKFPDLNHAVKRDPRTNMRSAQNNWDFWTSLPEALHQITIVMSDRGLPATYRHMHGFGSHTFSMINADNERVWVKFHFESNQGIQNLTDQEAEVVIGQNRESHHADLYDSLESGDFPSWTLKIQVMTEEQAEKSPYNPFDLTKVWPHKDYPLIEVGVMELNRNPENFFAEVEQSAFNPASIVPGISFSPDKMLQGRLFSYGDAQRYRLGVNHQQIPVNAPRCPVHSYHRDGAMRVDGNHGSTIGYEPNTQGEWQEQPDFSEPPMELSGAAAHWNHREDEDYFSQPGDLFRLMDNSQQQALFDNTARSVGGASIDIQKRHISHCLKADQAYGAGVAKALGILLDTI

SEQ ID NO: 9380 - protein, 245 aa, Paxistima myrsinites
ALSIAGAVQSQKLAVRAISQLQSLPGGDIKLLCDTVVESVRDLTGYDRVMVYKFHEDEHGEVVAESKRPDLEPYIGLHYPATDIPQASRFLFKQNRVRTIVDCHASPVRVIQDDGLMQPLCLVGSTLRAPHGCHAQYMENMGSIASLAMAVIINGNDEEVIGGRYATRLWGLVVCHHTSARCIPFPLRYACEFLMQAFGLQLNMELQLAAQLSEKHVWKTRTLLCDMLLRDSPPAIVTQSPSIMD

SEQ ID NO: 9381 - protein, 95 aa, Brassica oleracea
MGRGRVEMKRIENKINRQVTFSKRRAGLLKKAHEISILCDAEVSLIVFSHKGKLFEYSSESCMEKVLERYERYSYAEKQLKAPDSHVNAQTNWSV

SEQ ID NO: 9382 - protein, 361 aa, Peripterygia marginata
QKLAVRAISHLQSLPGGDIKLLCDTVVESVRDLTGYDRVMVYKFHEDEHGEVVAESKRPDLEPYIGLHYPATDIPQASRFLFKQNRVRMIVDCHASPVRVIQDDGLMQPLCLVGSTLRAPHGCHAQYMENMGSIASLAMAVIINGNDEEVIGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGNYYPLGVTPTEPQIKDIVEWLLAFHGDSTGLSTDSLADAGYAGAALLGDAVCGMAVAYITNRDFLFWFRSHTAKEIKWGGAKHHPEDKDDGQRMHPRSSFKAFLEVVKSRSLP

SEQ ID NO: 9383 - protein, 434 aa, Cytophaga hutchinsonii
MKRSIVWFKTDLRLHDNETLVRAIEQSDEIIPVYCLDEDHFKITPFGFQKTGNFRAQFLLESLNDLDTNLRKLGSGLIVVRGKPETELYKIVKQYEAFKVFAKREVAYEEQQTEARVEKEIWKLGCTFESFSTSTLYHAQDLPFSIKDIPEVFTNFRKKVEKESSIRSVFQKPAHIKSPAMPQLRLPTVKGLGLQPVIQDPRAVMKFTGGESEGCKRLTSYLFETQLISHYKNTRDGMIGSDYSTKFSPWLALGCLSPREIYTELKKYESRFSANESTYWLIFELLWRDYFRFMMKKHKHQFFLYSGIKDSANASGLQDTAILSQWINGKTGNDFIDANMLELTHTGFMSNRGRQNAASYLCNDLGIDWRYGAAYFEQQLIDYDVCSNWGNWAYLAGVGNDPRGKRNFNIEKQAEEYDPKKLFRNLWLKTTLPL

SEQ ID NO: 9384 - protein, 374 aa, Mortonia greggii
ALSIAGAVQSQKLAVRAISQLQSLPGGDIKLLCDAVVENVRNLTGYDRVMVYKFHEDEHGEVVAESKRPDLEPYIGLHYPATDIPQASRFLFKQNRVRMIVDCHSTPVSVIQDDGLMQPLCLVGSTLRAPHGCHAQYMANMGSIASLAMAVIINGNDEDGIGGRNTTRLWGLVVCHHTSARCIPFPLRYACEFLMQAFGLQLNMELQLASQLLEKHVLKTQTLLCDMLLRDSPTGIVTQSPSIMDLVKCDGAALYHQGKYYPLGVTPTEAQIKDIVEWLLAFHGESTGLSTDSLADAGYPGAALLGDAVCGMAVAYITDRDFLFWFRSNTAKEIKWGGAKHHPEDKDDGQRMHPRSSFKAFLEVVKSRSLPWEN

SEQ ID NO: 9385 - protein, 729 aa, Mannheimia succiniciproducens
MKKLVAQSVIDAFFDGTHSDPFAVLGMHETHNGIEIRVLLPEAHRVIVIDKETHKAVVELELVDERGFFNAIVPKANQFFAYELQVYWGKESQILEDPYRFHPMINELDNWLLAEGSHLRPYEVLGAHFVEYDNVAGVNFRVWAPNAKRVSVVGDFNYWDGRRHPMRFHPASGIWELFLPKVALGQLYKFELIDSNNQLRLKADPYAFAAQLRPDTASQVSALPEIVEMTEKRRAANQSDKPISIYEVHLGSWRRNLENNFWLDYDEIADELIPYVKEMGFTHIELLPISEYPFDGSWGYQPLGLYAPTSRFGTPDGFKRLIEKAHESGINVILDWVPGHFPSDTHGLAAFDGTSLYEYADPKEGYHQDWNTLIYNYGRHEVKNYLSGNALYWVERFGLDGLRVDAVASMIYRDYSRRDGEWVPNQYGGRENLEAIEFLKHTNYVLGTELPGVAAIAEESTSFPGVTLPPEHGGLGFHYKWNMGWMNDTLEYMKLDPVYRQYHHGKMTFAMLYQYSENFVLPLSHDEVVHGKGSLITKMSGDTWQKFANLRAYYGYMWAFPGKKLLFMGNEFAQGREWNYQESLDWFLLDDGQGGGWHSGVQRLVKDLNKTYQNQTALFELDTNPQGFEWLVVDDNQNSVFAFERRSKSGEVIIVVSNFTPVPRDNYRIGVNEPGKYEEILNTDSAYYKGSNLGNYGEVIAEEIENHGKAQSISVMVPPLATVYLRLKK

SEQ ID NO: 9386 - protein, 801 aa, Haematonectria haematococca
VEVKGEILELKNTINQMVDRLGTFAVEVSKVAREVGTDGTLGGQAQVANVEGKWKDLTENVNTMASNLTVQVRSISTVTQAIANGDMSQKIKVEANGEIQVLKETINNMVDRLSSFCYEVQRVAKDVGVDGKMGAQADVAGLDGRWKEITTDVNTMASNLTTQVRAFSDITNLATDGDFTKLVDVEASGEMDELKRKINQMISNLRDSIQRNTQAREAAELANKTKSEFLANMSHEIRTPMNGIIGMTQLTLDTDLTQYQREMLNIVNNLANSLLTIIDDILDLSKIEARRMVIEEIPYTLRGTVFDALKTLAVKANEKFLDLTYKVDSSVPDYVIGDSFRLRQIILNLVGNAIKFTEHGEVSLTIKERVEQRNVRPGEYAVEFIVEDTGIGIAKDKLDLIFDTFQQADGSMTRKFGGTGLGLSISKRVVNLMGGDLWVISEQGKGSEFHFTCLVKLAHDDAAMIEQQIRPYRGHQVLFVDKAQSKGGASIKGMLEQIGLHPVVVESEKSPALTRLQASGSLPYDAILVDSIDTARRLRAVDDFKYLPIVLLAPVVHVSLKSCLDLGITSYMTTPCKLIDLGNGMIPALENRATPSLADNTKSFEILLAEDNTVNQRLAVKILEKYHHVVTVVGNGWEAVEAVKRKKFDVILMDVQMPIMGGFEATGKIREYERGIGTHRTPIIALTAHAMMGDREKCIQAQMDEYLSKPLQQNHLIQTILKCATLGGPLLEKNRERELALHAEAKSSKHKEGGQGLLRPALESRSFTSREPLSGNGKESPALLSPDEDPMARVYMRSLSS

SEQ ID NO: 9387 - protein, 773 aa, Azoarcus evansii
MRIVCIGGGPAGLYFAILMKKLNPAHEIRVIERNRPYDTFGWGVVFSDATMDNMREWDSETADAIQVAFNHWDDIELHFKGRTIRSGGHGFVGIGRKMMLNILQARCEELGVELVFDREVESDAEFPDADLVIASDGINSRIRNKYAEVFKPDIVTRPNRYIWLGTTKLFDAFTFFFEKTEHGWFQAHIYKFDDKTTTFIVECPEHVWKAHGLDTADQEQSIAFCEQLFGKHLDGHRLMTNSRHLRGSAWLNFQRVKCEQWHHYNGKSHVVLMGDAVHTAHFAIGSGTKLALEDAIELTRLFRDEGDTREHIPAVLERYQAARNIDVLRLQNAAWNAMEWFEVCGARYCDTLEPEQFMYSMLTRSQRISHENLRLRDAGWLEGYERWLARKAGMTVRDDETPPPPMFTPFKLRGLTLANRIVMSPMAMYSAEDGAPTDFHLVHFGSRALGGAGLLYTEMTCVSPDARITPGCAGMYKPEHVNAWKRIVDFVHGNSDAKIGMQLGHAGRKGATKLAWEGIDEPLEAGAWELISASPLPYLPHSQVPRAMTRDDMERVRNDFVRATRMAAEAGFDILELHCAHGYLLSSFLSPLTNRRTDEFGGDLENRARFPLEVFKAMRAMWPTNRPMSVRLSCHDWFPGGNTADDAVAIARLFKEAGADIIDCSSGQVWKGDQPVYGRMYQTPFADRIRNEVGIPTLAVGAISEADHANSIIAAGRADLCAIARPHLADPAWTLHEAAKIGFGEVAWPKQYRSARGQYETNLQRAAAAVAGK

SEQ ID NO: 9388 - protein, 497 aa, Brassica juncea
MVALTAEKQDQNLLSRMAAGDGHGENSAYFDGWKAYEENPFHPINRPDGVIQMGLAENQLCGDLMRKWVLEHPEASICTAEGVNQFSDIAIFQDYHGLPEFRQAVAKFMEKTRNNKVRFDPDRIVMSGGATGAHETVAFCLANTGEGFLVPTPYYPGFDRDLRWRTGVNLVPVTCHSSNGFKITVEALEAAYENARVSNIPVKGLLITNPSNPLGTTLDRDCLKSLVNFTNNKGIHLIADEIYAATTFGQSEFISVAEVIEEVPHSNRDLIHIVYSLSKDMGLPGLRVGIVYSYNDRVVQIARKMSSFGLVSSQTQHLIAKMLSDEDFVDEFIRKSKLRLAARHAELTTGLDGLGIGWLKAGAGLFIWMDLRNLLKTATFDSEMELWRVIATNKVKLNVSPGGSCHCNEPGWFSMFANMDHKTMETALERIRVFTSQLEEESLKQTKPMAAPTVMAKKKMCWQSSLRLSFKDTRRFEEGFFSPHSPVPHSPLVRAQI

SEQ ID NO: 9389 - protein, 374 aa, Debaryomyces hansenii
MLQLKPRRIIFNISQNFQVIQVVGEGAYGVVCLAIHKPTGIKVAIKKLEPFEKPLFCLRALREIKLLTYFKKHENIISIFDVQKPLNFENFNEIYLIQEYMPSDLHKTIATQNLTDDHIQYFIYQILRGLKLIHSANVIHRDLKPSNILVNENCDLKICDFGLARLDILKEGYDKRLAINSGISMLTEYVATRWYRAPEIMLTSSQYSTAIDMWSVGCILAELFTCTPLFPGNDYRHQLILIFQLLGTPTDADLTCIKSQRAKNYIKTLPYCSPLSLDQVFNRHPNRAKRFGGQPINPLGLDLLKKLLVFDPKERLTVEEALEHPYVSTYHDPEDEPTIMPIPHEDFEFDKSKDKLSILELKRQLYNDIIKCNR

SEQ ID NO: 9390 - protein, 550 aa, Yersinia enterocolitica
MAAKDVKFGNDARIKMLRGVNILADAVKVTLGPKGRNVVLDKSFGSPTITKDGVSVAREIELEDKFENMGAQMVKEVASKANDAAGDGTTTATVLAQSIITEGLKAVAAGMNPMDLKRGIDKAVIAAVEELKKLSVPCSDSKAIAQVGTISANSDSTVGELIAQAMEKVGKEGVITVEEGSGLQDELDVVEGMQFDRGYLSPYFINKPETGSIELESPFILLADKKISNIREMLPVLEAVAKAGKPLLIIAEDVEGEALATLVVNTMRGIVKVAAVKAPGFGDRRKAMLQDIATLTAGTVISEEIGLELEKTTLEDLGQAKRVVINKDTTIIIDGVGDEAAIQGRVAQIRQQIEEATSDYDKEKLQERVAKLAGGVAVIKVGAATEVEMKEKKARVEDALHATRAAVEEGVVAGGGVALIRAASAITAAGLKGDNEDQNVGIKVALRAMESPLRQIVVNAGEEASVIANNVKAGSGSYGYNAYSEEYGDMIAMGILDPTKVTRSALQYAASIAGLMITTECMITDLPRDDKGADMGAGGMGGMGGMGGMM

SEQ ID NO: 9391 - protein, 478 aa, Glycine max
MAASVSTIGAVNRAPLSLNSSEAGDSVPSSAFFGTSLKKVTASRVPNVKISSGSFKIVAAEKEIDEQQQTNKDRWKGLAYDISDDQQDITRGKGMVDSLFQAPQETGTHYAVMSSFEYLSTGLKQYNLDNNMDGFYIAPAFMDKLVVHITKNFMTLPNIKVPLILGIWGGKGQGKSFQCELVFAKMGINPIMMSAGELESGNAGEPAKLIRQRYREAADIISKGKMCCLFINDLDAGAGRLGGTTQYTVNNQMVNATLMNIADNPTNVQLPGMYNKQENPRVPIIVTGNDFSTLYAPLIRDGRMEKFYWAPTRDDRVGVCKGIFRTDNVPEDEIVKLVDTFPGQSIDFFGALRARVYDDEVRKWISGVGVDLIGKKLVNSKEGPPTFDQPKMTLSKLLEYGNMLVQEQENVKRVQLADKYLNEAALGDANQDAIKRGTFYGKAAQQVKIPVPEGCTDPNASNFDPTARSDDGTCLYTP

SEQ ID NO: 9392 - protein, 509 aa, Unknown
  Burkholderia sp. 383
MMPPTRVVLRLAVCAAVTAALLPCASSVRAQQPASAPPASAPAAQPPSPCPPDWEPQICELKAAVEVLKKQHLTDIDIGALLDATTHAGIKTLPYARFFDAKEEQERRDDERRARDGTPGIGIVFETRPDGLHIVDVIPDAPAEKAGVRPDDLVVAMNDTSVVGIDPADLAKLSKGDAGVPLKLTVQRGPSHTVLNFAPVRTILKPHPATAKRLDGDILYTRLSSFPEPAVGDYIDAVQAARRAGPPVKGLILDLRINGGGALNAAIGITALFTGRDRTAMVTVERGDANRRRYTTNWPDYELPVMHGQDPLATLQTDVWWRTVPLVVLVDGQSASAAEATAAALKDLGRAKLLGMPTYGKGLAQTGVDLIDGTRLNFTYARNLRPNGCPMDGYGVVPDWLVPPRRDSDVDGVLLWYREADLPRAPYADRLAPDPFAKVRKERQKLREQRALAKIDTAKSAALPQREFGTATDWQLRQALAALAGRPVRTIEAKPQLMPARPVCERAGN

SEQ ID NO: 9393 - protein, 176 aa, Gossypium hirsutum
LFSFILILTHFLLKSSIRIQVLGWICVAISVSVFAAPLNIMARVVRTKSVEFMPFTLSFFLTLSAVMWFAYGLFIKDLCVALPNVLGFILGMLQMLLYAIHRHSEKVNIEEKKLPAEQMKSINVVLTTLGASEVHPVVLDIHTDDTKEEDNKNNEPTGEPDKQTDVKMEDANESPV

SEQ ID NO: 9394 - protein, 499 aa, Brucella suis
MTDRPIMTTSAGAPIPDNQNSLTAGERGPILMQDYQLIEKLSHQNRERIPERAVHAKGWGAYGTLTITGDISRYTKAKVLQPGAQTPMLARFSTVAGELGAADAERDVRGFALKFYTQEGNWDLVGNNTPVFFVRDPLKFPDFIHTQKRHPRTHLRSATAMWDFWSLSPESLHQVTILMSDRGLPTDVRHINGYGSHTYSFWNDAGERYWVKFHFKTMQGHKHWTNAEAEQVIGRTRESTQEDLFSAIENGEFPKWKVQVQIMPELDADKTPYNPFDLTKVWPHADYPPIDIGVMELNRNPENYFTEVENAAFSPSNIVPGIGFSPDKMLQARIFSYADAHRHRLGTHYESIPVNQPKCLVHHYHRDGQMNVYGGIKTGNPDAYYEPNSFNGPVEQPSAKEPPLCISGNADRYNHRIGNDDYSQPRALFNLFDAAQKQRLFSNIAAAMKGVPGFIVERQLGHFKLIHPEYEAGVRKALKDAHGYDANTIALNEKITAAE

SEQ ID NO: 9395 - protein, 475 aa, Wigglesworthia glossinidia
MIDNLIWFRKDLRLNDNPALYYACVDEYKSASGILILNKKKWNEKIVSKNRIRFMYKNIFSLKRNLKKIGIELIFYTCRDFFEYTCLLYNFCYTNKVKELYFNKGIEKEDLEEDKIIIKKLKKITKCICFNGNLLIDPEKIKNKNKKTYKVYSYFLKSCISFISNNNINIIPFPKIRKNKLNLIKSYNDSIKIKKKLSPCYEEHALNKLNNFIKLKINKYHITRDFCINSTSFLSPYINIGVLSLRECINNIKNNNFDFIEKKNSGHFKWFSEIIWREFCHHLIIEYSDFFDSKKLIKWTKYIKWENKIKKIQAWKNGTTGFPIIDAAMRQLKKTGWMHNRLRMITSSFLVKDLLVDWKIGEKYFYYHLIDGNSAINNFNWQWISSSGICSSPYFRMINPITQSKKFKSIYKYIKFWIPELKNIPFNEIHEPYNWIIKNKINYPNQIIEHKTAKINFFKACKKAIYIFKSKNINK

SEQ ID NO: 9396 - protein, 520 aa, Methanopyrus kandleri
MCGIACAVGDDDIAAMVTAMEHRGPDGRGFASVSDDGVEFSEEPPSEGEVVLGHVRLWVRGEASAVQPIVEEDRAVAVNGEIYNYRRFVEDAPSDSWAVFEVVRSVRDAAAALRVLRGEYAFVAAFRDGTVVAARDPIGVRPLYYCVEAGLAVASERKALWAAGFRDVRRVPPGALLVLRDGRVELRNVVDVPRSRPGRSSWKDLLEVLQRSVRERVEETERVGVVLSGGVDSSTVAKLASEYVDVKCYAAGFEGSDDVEVAERLCDEMGWPFVSVSLEDEFERYVVATVYAVETWNPMKVEVGIPILACAGAMSDDGIRVMLSGQGADELLGGYHRHLRHYGDWDRFSWELWKDVAAIHAVNLERDDKAGMHHSVELRVPYLDLDVVRTGLGIDPRENVSGPEDNLRKRALRRVAAELGLPDFVVERRKRATQYGSLTSKMLDKLVRELGIKRAVAKRLGYRSHKELFLRLVGKYLGFPWEAPSVEEVERECARLGVEPEISEFLEERVLTFDSDLRAG

SEQ ID NO: 9397 - protein, 1014 aa, Burkholderia pseudomallei
MPGKLKELLIQPFKLNHRKALFDPRRMLAHQRLLTYGGAIGISAFILFCLLLMIRMEAMDYVSNARSEFLIQQSKLTIKLQIRRTALMRAVMHAEGLWNRRIEPSTELLSQFDAHQGYAVLHTPQGAPAALAVGIPAPGRSASAFAPYLALLETQLLMGDGQSPLPDDRVEGYSFSPDGTYLSLLWSREDQAPEAFIESHSASGLIGDAMRGIRYLRDASTIVPLRADRRTVWLPPHPDPLTGKPMIRIVQPAIDATGKLFAIYVRSLPLDMFYSNLNDAPAGSTLTIVDRKGNVILGSSNQHGGDGGATASALGIRSLGDGFGGLVERYQDGMFVTSDQLPGTDWVLVHAYSWKTIAAALALRFSLVTGLVAGIIVMLWLFAIQFDRKGLIPNYRRAQRLLESEVLNRTILRTAPVGLGLLSAQDGSVLLQNNAMLELSARTSDEPLPIRLWEAYRHAVGRSSDEDGALLQHDLAIEREGANPVYLQANVVAARYRGANVLLCTLLDISLRKESELKLKEARIAADQANKAKSTFLATMSHEIRTPLNAIIGNLELLRRSPLSEQQSERLHVVESCSNALLHIINDILDLSKVESGQMTLENIPFDIHALLQETVDAYAPLAESKGLALLSSIGEGVARHYAGDPTRIRQVLSNLIGNAIKFTERGHISIDVHRAKAARDGSAIEIWVNDTGIGIRPDRIATLFDVYTQADASIHRRFGGSGLGLPLCQRLVTIMGGSIEIDSLPDFGTTVTVALPLREARHATALSNGPAARRRNATALARPTLHVLVAEDHPANRALLRDQLEALDHRVDVVENGREALRAFGEHQYDIVLTDLGMPELDGYGFARFANKMRAGTPIVAMTAHATDEDYQRSKKVGIAEIVLKPLSLTTLEKVLQRHAMRAPAEEIVTAAGPGPAHAEPRMRALPPAVAAALRTATLQSIDKIAQALAARNFETIRQELHSIKGGFALTGNRLLIARCAATEELAEAEDLDTLRAAWRKLEASLLEALERL

SEQ ID NO: 9398 - protein, 544 aa, Yarrowia lipolytica
MVLSEHVNADKLLSNLTGKGDEHAIRALIASHTLRDPYSSKYNSQEPIPKFRIPEEGCEEKQAYQLIKDDLDLDGKPNLNLASFVNTYISDRAEKLAVENLTKNLADADEYPALMTVHARCVSILGHLWNNTDHEKAIGTATTGSSEAIHLGGLAMKKRWQEKRRAAGKSTEKPNILMAANAQVALEKFARYFDVEDRIIPVREASKHCLDLSKIKENLDENTIGIFVIMGSTYTGHYEDVQGVAKILDEYEKETGHSIDIHVDGASGAMVAPFLYPDLEWDFRVPRVKSINTSGHKFGLTTAGLGWILWRDAKYLPKELIFELHYLGGKEESYTLNFSRPGFPVLHQYYNFLHLGFDGYKQLHASSMANARLLSVFLEATGHYTCVSEIHLPANGSKPKDVKHVATADPLQYMAGLPVVAFRFSDSFRKAHPEVPQAAVSTLLRVKGYIIPNYELPPSEQKTEILRVVVRQSMSIDLLDRLMEDISAITNVLLEAVEDVKKLRAEGDHDPQLIHKYVLTLVTGKPVEEREEDWEGHSTFRAAC

SEQ ID NO: 9399 - protein, 380 aa, Gibberella zeae
MDSAARQQPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYFESDAADLVRATLSAVAYLHDHGIVHRDLKPENLLFRTPEDNADLLIADFGLSRIMDEEQFHVLTTTCGTPGYMAPEIFKKTGHGKPVDLWALGVITYFLLCGYTPFDRDSDFEEMQAILNADYSFTPIEYWRGVSAHAKDFIQRCLTIDSTKRITAHEALQHPFVAGFINAEGESQNLLPNIKKNFNARRTLHAAIDTVRAINKLREAQSGLMDGARSKEPSRGAAQQTPTNRKHPTSHPRCNPATTEIELSKLPKVSGAQRRAVRIR

SEQ ID NO: 9400 - protein, 374 aa, Mortonia greggii
ALSIAGAVQSQKLAVRAISQLQSLPGGDIKLLCDAVVENVRNLTGYDRVMVYKFHEDGHGEAVAESKRPDLEPYIGLHYPATDIPQASRFLFKQNRVRMIVDCHSTPVSVIQDDGLMQPLCLVGSTLRAPHGCHAQYMANMGSIASLAMAVIINGNDEDGIGGRNTTRLWGLVVCHHTSARSIPFPLRYACEFLMQAFGLPLNMELQLASQLLEKHVLKTQTLLCDMLLRDSPTGIVTQSPSIMDLVKCDGAALYHQGKYYPLGVTPTEAQIKDIVEWLLAFHGESTGLSTDSLADAGYPGAALLGDAVCGMAVAYITDRDFLFWFRSNTAKEIKWGGAKHHPEDKDDGQRMHPRSSFKAFLEVVKSRSLPWEN

SEQ ID NO: 9401 - protein, 374 aa, Plagiopteron suaveolens
ALSIAGAVQSQKLAVRAISQLQSLPGGDIKLLCDTVVQSVRDLTGYDRVMVYKFHEDEHGEVIAESKRPDLEPYIGLHYPATDIPQASRFLFKQNRVRIIVDCHASPVSVIQDDGLMQPLCLVGSTLRAPHGCHAQYMDNMGSIASLAMAVIINGNDEDGTGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATLLGDAVCGMTVAYITNRDFLFWFRSHTAKEIKWGGAKHHPEDKDDGQRMHPRSSFKAFLEVVKSRSLPWEN

SEQ ID NO: 9402 - protein, 305 aa, Arabidopsis thaliana
MAELTQADVVYSPRSFQVWKTLVNWLAFFYQIFLQILRAVGYHPLLSSSAKASADGFKPLPAIELLDRASESPTTVEIAATTTSDSCSDGARSRFQRLKVVLDLDETLVCAYETSSLPAALRNQAIEAGLKWFELECLSTDKEYDGKPKINYVTVFERPGLHEFLEQLSEFADLILFTAGLEGYARPLVDRIDTRKVLTNRLYRPSTVSTQYRDHVKDLLSTSKNMCRTVIVDNNPFSFLLQPSNGIPCIAFSAGQPNDTQLLDVILPLLKQLSEEDDVRPTLYDRFRMPEWFEKQGIPPSCWKP

SEQ ID NO: 9403 - protein, 374 aa, Plagiopteron suaveolens
ALSIAGAVQSQKLAVRAISQLQSLPGGDIKLLCDTVVQSVRDLTGYDRVMVYKFHEDEHGEVIAESKRPDLEPYIGLHYPATDIPQASRFLFKQNRVRIIVDCHASPVSVIQDDGLMQPLCLVGSTLRAPHGCHAQYMDNMGSIASLAMAVIINGNDEDGTGGRNPTRLWGLVGWHHPSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATLLGDAVCGMAVAYITNRDFLFWFRSHTAKEIKWGGAKHHPEDKDDGQRMHPRSSFKAFLEEVKSRSLPWEN

SEQ ID NO: 9404 - protein, 232 aa, Triticum aestivum
  misc_feature (57)..(57): Xaa can be any naturally occurring amino acid
  misc_feature (69)..(69): Xaa can be any naturally occurring amino acid
  misc_feature (180)..(180): Xaa can be any naturally occurring amino acid
MVISHASSSAGEAVYSTFSSRYVREELPRYRMPEGSIPKEAAYQIISDELMLDGNPXRLNLASFVTTWXMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVEXLKEVQLTEGYYVMDPKKAIEMVDENTICVAAILGSTLTGEYKNGKLVNDLLG

SEQ ID NO: 9405 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGTVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAMPDMGGMGGMGGMM

SEQ ID NO: 9406 - protein, 365 aa, Pleurostylia opposita
VQSQKLAVRAISQLQSLPGGDIKLLCDTVVESVRDLTGYDRVMVYKFHEDEHGEVVAESKRPDLEPYIGLHYPATDIPQASRFLFKQNRVRIIVDCHASPVRVLQDDGLMQPLCLVGSTLRAPHGCHAQYMENMGSIASLAMAVIINGNDEEAIDGKNPTRLWGLVVCHHTSARCIPFPLRYACEFLMQAFGLQLNMELQLAAQVLEKHVLKTQTLLCDMLLRDSPIGIVTQSPSIMDLVKCDGAALYYRGNYYPLGVTPTEAQIKDIEEWLLAFHGDSSGLSTDSLADAGYPGAALLGDAVCGMAVAYITNRDFLFWFRSHTAKEIKWGGAKHHPEDKDDGQRMHPRSSFKAFLEVVKSRSLPW

SEQ ID NO: 9407 - protein, 540 aa, Rubrobacter xylanophilus
MAHKELKFNTEARQALERGVNKLADAVKVTLGPKGQYVVLDKKFGSPTITNDGVTIAREIELEDIFENQGAQLLKEVATKTNDVAGDGTTTATVLAQIIVREGLKNVAAGANPVILRNGIEKAVEKAVEAIREQAKEISGKDEIARVGAISARSEEVGNVIAEAIDKVGKDGVVNVEEGQTLGIDLEFTEGMQFDKGYLSPYFVTDQDRMEAVLEDPYILIANQKISNVQDLLPLLNQVMQANKPLLIIAEDVEGEALATLIVNKLRGTFQSCAVKAPGFGDRRKRMMEDIAILTGGEVITEELGLKLENTQLSQLGRARKVVVTKDDTTIVDGAGDPEQIKGRINQIKAELETTDSDFDREKLQERLAKLAGGVAVIKVGAATETELKEKKHRVEDALSATRAALEEGIVPGGGVALLKAQKAVGELLDELDGDERTGARIVYRALEEPIRQIAENAGADGSIVVDKVRAQGDSIGFNALTGGYEDLVAAGVIDPAMVTRSALQNAASIAGLLVTTDVVVAEPEEEQPAMPGGGMGGMM

SEQ ID NO: 9408 - protein, 374 aa, Pristimera andina
ALSIAGAVQSQKLAVRAISQLQSLPGGDIKLLCDTAVESVRDLTGYDRVMVYKFHEDEHGEVVAESKRPDLEPYIGLHYPATDIPQASRFLFKQNRVRIIVDCHASPVNVIQDGGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLVFHGDSTGLSTDSLADAGYPGATLLGDAVCGMAVAYITNRDFLFWFRSHTAKEIKWGGAKHHPEDKDDGLRMHPRSSFKAFLEVVKSRSLPWEN

SEQ ID NO: 9409 - protein, 395 aa, Methanosarcina acetivorans
MNEQGLSEKEIFSYLENAKSEDTDYYRVLSSMCTHPHKIAVEANRLFIEANLGDLGLFAGASRLEQEVVGMLGELLHAPSIDVPFGGSCESSACGYLTTGGTESNIQAVRGMKNLVTTGKKELKGAPNIVIPESAHFSFDKVADMMGIEVRRASLDSEFRVDMASIESLIDANTIGLIGIAGNTEFGQIDPIDKLSEIALENELFLHIDAAFGGFVIPFLEKPQPFDFKLPGVTSIAVDPHKMGLSTIPSGALLFRSASFLDSLKVNTPYLTTKAQFTLTGTRSGASAAATCAVMKYLGNEGYRKNVQYCMQLTEKLVIEARKIGFEPLLEPVMNVVALKVPNPDFVREQMLERFGWNVSITRTPRALRLVLMPHNTLEDIEIFVQDLKEVTVEI

SEQ ID NO: 9410 - protein, 215 aa, Cucumis sativus
EIKRIENTTNRQVTFCKRRNGLLKKAYELSVLCDAEVALIVFSSRGRLYEYANNSVKATIDRYKKASSDSSNTGSTSEANTQFYQQEAAKLRVQIGNLQNPNRNMLGESLSSLTAKDLKGLETKLEKGISRIRSKKNELLFAEIEYMRKREIDLHNNNQMLRAKIAESERNVNMMGGEFELMQSHPYDPRDFFQVNGLQHNHQYPRQDNMALQLV

SEQ ID NO: 9411 - protein, 693 aa, Oryza sativa
MGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 9412 - protein, 445 aa, Unknown
  Synechococcus sp. WH 8102
MPSAKGLRGVLRSGPLLLMLGLGGMAVSMAGPSLGLTGASGGAITDSPKEVIDQVWQIVFRDYLDSTGAYSDARWRQLRKDLLAKSYAGDEESYEAIRGMLSSLDDPYTRFLDPKEFKEMRIDTSGELMGVGIQLSLDKDTKELIVVSPIEGTPASRAGVQPKDVIVSIDGAPTKGMTTEEAVKLIRGPEGTEVILGLRRKGVVLNVSLTRARIEIHAVKKALNTSANGSKIGYIRLKQFNANASREMRAAIQDLDEQGAQGYVLDLRSNPGGLLEASIDIARQWLNEGTIVSTRTREGIRDVRRATGSAITDKPMVVLIDQGSASASEILSGALQENKRAQLVGQKTFGKGLVQAVRGLSDGSGMTVTIAKYLTPNGTDIHKNGIKPDVEAAMSEKEMKDFKIENLGTSKDSQYRVAETTLIKVLRMQKNEAYRPGSANLKAAL

SEQ ID NO: 9413 - protein, 492 aa, Oryza sativa
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRVFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 9414 - protein, 325 aa, Debaryomyces hansenii
MPQHKLATEVYFDLNDGHKIPALGLGTVPPEDNAEVKDQVITAVRAGYRHIDTAWYYGTEPYIGEALKVLFAEGYKREDLFITSKVWPSFHHSPEKSLDKSLSALGIEYVDLFLQHWPVCLSGDENGLPAAPKNDDGSLKYDDDPVDGVGFIETYKKLEDIKATNKARSIGVSNYSIPRLRKLLQKAKIVPVLNQIEYHPQLPQQDLVDFCQKHKILVEAYSPVGGPGAPVLKLPYINELAEKYEVSVNEITNAYHILQGRITLPRSSNLERIKTNVRLPQLTKDELDKLYQIGVENPTRYLVDSWGYGIGFRWWKGDTWSKEFD

SEQ ID NO: 9415 - protein, 237 aa, Lycopodium annotinum
MGRGKIEIKRIENATCRQVTFSKRRSGLLKKAHELSVLCDAQVAVIIFSSTGKLFQFASTRMKEILERYERNSDPLQIDAVIPRDLEYWSREAAKAKDELDRCHQKNRHMLGEDLSALNLNELEELEQQLDSGLRRVRCRKDQVLRDRIEELTKQESFLREENRMLRSKIAVPKESTEPILDEMNMETREPPSMAIVEEELSLKLNSKTWPDIHFSLQLGQYQPPRTETPTANHRPN

SEQ ID NO: 9416 - protein, 400 aa, Saccharomyces cerevisiae
MPFVKGFEPISLRDTNLFEPIKIGNTQLAHRAVMPPLTRMRATHPGNIPNKEWAAVYYGQRAQRPGTMIITEGTFISSQAGGYDNAPGIWSDEQVAEWKNIFLAIHDCQSFAWVQLWSLGWASFPDVLARDGLRYDCASDRVYMNATLQEKAKDANNLEHSLTKDDIKQYIKDYIHAAKNSIAAGADGVEIHSANGYLLNQFLDPHSNKRTDEYGGTIENRARFTLEVVDALIETIGPERVGLRLSPYGTFNSMSGGAEPGIIAQYSYVLGELEKRAKAGKRLAFVHLVEPRVTDPSLVEGEGEYSEGTNDFAYSIWKGPIIRAGNYALHPEVVREQVKDPRTLIGYGRFFISNPDLVYRLEEGLPLNKYDRSTFYTMSAEGYTDYPTYEEAVDLGWNKN

SEQ ID NO: 9417 - protein, 574 aa, Avena sativa
MALLCSALSNSTHPSFRSHIGANSENLWHLSADPAQKSKRRCNLTLSSRAARISSALESAKQVKPWQVPKRDWFPPEFMFGAASAAYQIEGAWNEGGKGPSSWDNFCHSHPDRIMDKSNADVAANSYYMYKEDVRMLKEIGMDSYRFSISWPRILPKGTLDGGINHEGIQYYNDLLDCLIENGIKPYITLFHWDTPQALADEYKDFLDRRIVKDYTDYATVCFEHFGDKVKNWFTFNEPHSFCGLGYGTGLHAPGARCSAGMTCVIPEEDALRNPYIVGHNLLLAHAETVDVYNKFYKGDDGQIGMVLDVMAYEPYGNNFLDQQAQERAIDFHIGWFLEPMVRGDYPFSMRSLVGDRLPFFTKSEQEKLVSSYDFVGINYYTSRFAKHIDISPEFIPKINTDDVYSNPEVNDSNGIPIGPDVGMYFIYSYPKGLKNILLRMKEKYGNPPIYITENGTADMDGWGNPPMTDPLDDPLRIEYLQQHMTAIKEAIDLGRRTLRGHFTWSLIDNFEWSLGYLSRFGIVYIDRNDGCKRIMKKSAKWLKEFNGATKKLNNKILGASSCCSGVTHGGGTA

SEQ ID NO: 9418 - protein, 445 aa, Oryza sativa
  misc_feature (6)..(6): Xaa can be any naturally occurring amino acid
MAPTTXAAAAASSNGGGESDGSSKEWRLTAPTRGGAMAAAGDKMSIRAVRYKISASVDDRGPRPVLPLAHGDPSVFPEFRTAAEAEDAVADALRSGDFNCYPAGVGLPAARRAVADHLSRDLPYKLSSDDIFLTAGGTQAIEVVISILAQPGTNILLPRPGYPNYEARAAFNNLEVRHFDLIPEKGWEIDLNSLESIADKNTTAIVIINPNNPCGNVYTYEHLSKVAEVARKLGILVITDEVYGNLVFGSSPFVPMGCFGHIVPILTIGSLSKRWIVPGWRLGWVAICDPKKTLQETKIATLITNFLNVSTDPATFIQGALPNILKNTKEEFFKRIIDLLTETSDICYRGIKDIKCITCPHKPEGSMFVMVKLNLYLLEGIHDDVDFCCQLAKEESVILCPGSVLGMKNWVRITFAIDSSSLLDGLERIKSFCQRHKKKNPLNYI

SEQ ID NO: 9419 - protein, 594 aa, Sporobolomyces singularis
MMLHAALLVALPCVVLARPAGAVTYPGAIPLSLTSNYETPSPTAIPLEPTPTATGTAELDALWNLVEAQYPVQTAAVTTLVTVPDDYKFEADPPSYALAGYETSEIAGLKFPKGFKFGVAGAAIQVEGAAKAEGRGPSTWDYLCHHYASTQCNNYDPDITTNHYYLYPLDFARLQHLGINTYSFSISWTRIYPLGAGYVNEAGLAHYDAVIHSAKKYGLEPVGTVFHWDTPLSLMLKYGAWQDTGDQIVKDFVTYATTVFKRYGNEVKTWFTFNEPRVFCSQNSGLPYNLTYPEGINSTSAVFRCTYNVLKAHGHAVKVYRDLVASGTIAAGEIGFKSDDNYPIPARPGNADDEESAKRHEAFRIGIFAQPVYGNGDYPDVVKETVGDMLPALTDEDKGYIKGSGDIFAIDGYRTDISHAALNGIANCIRNQSDPNWPVCEEGSDPFAHVYPSGFAIGQSADPLSSWLVNSAPFIRDQLKFLTQTYPAKGGIYFSEFGWAEDAEYDRQLLYQITWDGLRTQYLTDYLSQLLLAVHKDGINLRGALTWSFVDNWEWGLGMQQKFGFQFVNQSDPDLTRTFKLSAHAYAQFGRNHL

SEQ ID NO: 9420 - protein, 129 aa, Gibberella zeae
MSMWLTDTQKIGVVFCSGGFANFLSRLAMGNILFLIGLTIIIGPQKTLLFFARKQKAKGTAAFFLGLILIFMKWTFIGFLVEAYGIVVLFGDFLGTIAGFAQGLPVVGPYIGMIVDRIGLGRRNAELPV

SEQ ID NO: 9421 - protein, 374 aa, Pristimera andina
ALSIAGAVQSQKLAVRAISRLQSLPGGDIKLLCDTAVESVRDLTGYDRVMVYKFHEDEHGEVVAGSKRPDLEPYIGLHYPATDIPQASRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLVFHGDSTGLSTDSLADAGYPGATLLGDAVCGMAVAYITNRDFLFWFRSHTAKEIKWGGAKHHPEDKDDGLRMHPRSSFKAFLEVVKSRSLPWEN

SEQ ID NO: 9422 - protein, 374 aa, Psammomoya choretroides
ALSIAGAVQSQKLAVRAISQLQSLPGGDIKLLCDTVVESVADLTGYDRVMVYRFHEDEHGEVVAESKRPDLEPYIGLHYPATDIPQASRFLFKQNRVRMIVDCHASPVHVIQDDGLMQPLCLVGSTLRAPHGCHAQYMENMGSIASLAMAVIINGNDEEVIGGRNPTRLWGLVVCPHTSARCIPFPLRYACEFLMQAFGLQLNMELQLAAQLLEKHVLKTQTLLCDMLLRDSPTGIVTQSPSIMDLVKCDGAALYYRGNYYPLGVTPTEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSLPWEN

SEQ ID NO: 9423 - protein, 515 aa, Kluyveromyces lactis
MASIDESGEVYCDKEVVTKVFARLTTKSENRACFDCGAKNPTWTSVPFGVLLCIDCSGEHRNMGTHITFVKSSNLDKWTVNNLRRFKLGGNDKAKDFFLKNNGKQYLGSSSNRMAKYTSQVAKKWQSHLNQKVARDAEQHPGEIVFSAEDEQEFTGGSSGSSKSNSVDDFFSNWEKPVNQSNISLTSSPRNLTPTNTGNRNGSSILSGSGSANKTSNGARSTTTKRTTLTGSAGSSQAKKHSILSSSRKSKKPVAAKKVDADLFDQFEKEAKEEEELASSLATTSLNSNNLSNSIYDATPAPFQQKSGFSSSSKITKPSTNVEDAEDDEWSNRYNDGITFDQINASNVGLTGSKDAAKPKLAKLGFGMTSNNAEKEQNKTNESRRAASGPKYTGKIAQKFGEQKGISSDQVFSRGSYDDEASKEAQEKLRQNFSNATSISSASYFGEGQSEDQFDEFGRPLNPQNGTRTNRSGSLGGRNFMEFTSGADDEFDLLKNAVEQGAQKLGNYLRDYMRN

SEQ ID NO: 9424 - protein, 107 aa, Hordeum vulgare
MAEAAHGGGLRGRGVLLGGVQDAPAGRENDLETIELARFAVAEHNAKANALLEFEKLVKVRQQVVAGCMHYFTIEVKEGGAKKLYEAKVWEKAWENFKQLQEFKPAA

SEQ ID NO: 9425 - protein, 374 aa, Psammomoya choretroides
ALSIAGAVQSQKLAVRAISQLQSLPGGDIKLLCDTVVESVADLTGYDRVMVYRFHEDEHGEVVAESKRPDLEPYIGLHYPATDIPQASRFLFKQNRVRMIVDCHASPVHVIQDDGLMQPLCLVGSTLRAPHGCHAQYMENMGSIASLAMAVIINGNDEEVIGGRNPTRLWGLVVCHHTSARCVPFPLRYACEFLMQAFGLQLNMELQLAAQLLEKHVLKTQTLLCDMLLRDSPTGIVTQSPSIMDLVKCDGAALYYRGNYYPLGVTPTEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSLPWEN

SEQ ID NO: 9426 - protein, 896 aa, Pseudomonas viridiflava
MAAVLGGYFTWMQLYELQSQLLQRGEMIAQDLAPLSANALGRKDKILLTRIATQTLEQSDVRAVSFLDTDRSVLAHAGPTMISPSPIGSSTQLLNSSGNDATRYLLPVFGHQRHLTSPIIPAEADTLLGWVELEISHNGTLLRGYRSLFASLLLIFTGLAFTAILAVRMSRTINGPLSQIKQAVSQLKDGNLETRLPPLGSRELDELASGINRMAATLQNAQEELQMSIDQATEDVRQNLETIEIQNIELDLARKEALEASRIKSEFLANMSHEIRTPLNGILGFTHLLQKSELTPRQYDYLGTIEKSADNLLSIINEILDFSKIEAGKLVLDNIPFNLRDLLQDTLTILAPAAHAKQLELVSLVYRDTPLALSGDPLRLRQILTNLVSNAIKFTRQGTIVARAMLEDETEEHAQLRISVQDTGIGLSSQDVRALFQAFSQADNSISRQPGGTGLGLVISKRLIEQMGGEIGVDSTPGEGSEFWISLNLPKAREDREETANQALEGLRAAVLEHHDLARQALEHQLEDCGLQTVVFTNLENLLNGVTAAHETPQAIDLVVLGVTALEISPERLRQHIWDLENLNCKVMVLCPTTEHALFQMSVHDVYTQLQAKPACNRKLQKALSELVAPRAVRTDVALPLSSRAPRVLCVDDNPANLLLVQTLLEDMGAEVVAVDGGYAAVSAVQQEAFDLVLMDVQMPGMDGCQATEAIRAWETERNQTSLPIVALTAHAMANEKRSLLQSGMDDYLTKPISERQLAQVVLKWTGLALRNPIPERQTESSNAHVGPLVLDHEEGLRLAAGKPDLAADMLAMLLASLDADREAIRAARANDDIQGLIERVHRLHGATRYCGVPQLRTACQRAETLLKQNAPHTEDALDDLDKAITRLEAEARVTA

SEQ ID NO: 9427 - protein, 374 aa, Pterocelastrus tricuspidatus
ALSIAGAVQSQKLAVRAISQLQSLPGGDIKLLCDTVVESVRDLTGYDRVMVYKFHEDEHGEVMAESRRPDLEPYIGLHYPASDIPQASRFLFKQNRVRMIVDCHASPVLVIQDDGLMQPLCLVGSTLRAPHGCHAQYMENMSSIASLAMAVIINGSDEEGVGGRNPTRLWGLVVCHHTSARCIPFPLRYACEFLMQAFGLQLNMELQLAAQLLEKHVLKTQTLLCDMLLRDSPTGIVTQSPSIMDLVKCDGAALYYQGNYYPLGVTPTEAQIKDIVEWLLAFHGDSTGLSTDSLADAGYPGAALLGDAVCGMSVAYITNRDFLFWFRSHTAKEIKWGGAKHHPEDKDDGQRMHPRSSFKAFLEVVKSRSLPWEN

SEQ ID NO: 9428 - protein, 344 aa, Arabidopsis thaliana
MDHAADAHRTDLMTITRFVLNEQSKYPESRGDFTILLSHIVLGCKFVCSAVNKAGLAKLIGLAGETNIQASFGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 9429 - protein, 152 aa, Nocardia farcinica
MEVIAVLRFDPFHDIDTVARHLLGEGTGTARAPRFMPMDLFKAGDHYVLNADLPGVDPGSVDVSVDNGTLTLRAQRSVPSEEGVQWIASERFAGTYMRQLSLGDNVDTDKISATYNNGVLSVTIPIAEKAKPRRIEITGGSEQKTIEASSNN

SEQ ID NO: 9430 - protein, 61 aa, Cucumis melo
DTLLDADLESDALGWQYISGTLPDSREFDRIDNPQLEGYKFDPNGEYVRRWLPELSRLPTE

SEQ ID NO: 9431 - protein, 372 aa, Unknown
  Bradyrhizobium sp. BTAi1
MSDLDTSVLFRPFRLKTLELKNRIVMAPMTRNAAPNGIPGEANVAYYRRRAEGGVGLILTEGTVVNRPASKNEPNIPFFHGDAALAGWQSVASAVHAAGGRIAPQIWHTGSTKGMSRWEPDAPVESPSGLVAPDKPRGKVMTENDIADTVAAFAQAAADAKRTGFDTVEIHGAHGYLIDQFFWSGTNKREDRYGGATIKERSRFAGEIVAAIRKAVGPDFPIILRVSQWKQQDYAARLAETPALMGDWLQPLVDAGVDILHCSQRRFWEPEFPEIDGEKGLNFAGWAKKITGAATISVGSVGLSGDFFSAFAGKPSTTADLDALLERMAKDEFDLIAVGRVLISDADWVAKIKAGDKSSLKGFNAADLGALV

SEQ ID NO: 9432 - protein, 485 aa, Solibacter usitatus
MLRSTLVLLCTACLLSAQDDFEKQMRSVIGAYAIAAENAADPITSEQAFYAGAIPGLLRKLDPHSIFFDPEQFEQLKRMESSTSKGFGSVVSILPGRVIVLQTISGTPSQKAGLAPGDEILAINGYVIGQLDIEQLPQLLEQSRQRQARLDVRRPGVPGLMHFTLTPEEMQSPSVDRAFFLAAGIGYIRVSSFDEKTGQQIKAAIEKLGGDRLAGLVLDLRNNPGGVLGAAIETCSLFLKPGMKIVTVRGRHVPETTEVVPSIAAPYGFKLAILVNEKSASASEVVSGAMQDHDRATIIGVPSFGKGLVQSVFPLTQNTGLALTTALYYTPSGRSIQKPLDSAKFALGPTTAHPNAQSEFHTDKGRRVTGGGGIQPDFVVNPSPSNRLRAVLDASASFTNFATEYLRAHKVDADFEVTPELLDQFRVFLSDREIRPGLAEWLTERDFVSNRLKTELFNQAIGVEKGDEVEAQRDPVILKALEVIG

SEQ ID NO: 9433 - protein, 616 aa, Streptococcus suis
MEIAMTEFTDLDLYYMNAGEHTTLYEKMGAHIIKERNKIIGTQFRVYAPNAREVFLVGNFNEWQRSHSMEREIDGVFQLYVDGLKSLEDYKYLIITHDGREIYKADPYAFFSQVRPDTASTTYNSRYKFKDDIWMYNRVNYDFKEQPVSIYEVHLGSWKQKFANKNEGGAPVEAFNSYKEITPLLIEHIRENNYTHIELLPITEHPLDASWGYQVTGYYSPTSRYGKPDELKYLVDQCHQAGIGVILDWVPLHFCKDAHGLYQFDGSWLYEYSYEQDRENHQWGTANFDLGKGLTRSFLLSNLKYWLEYFHFDGIRVDALSYLLYWRGETDEDKINHAAIDFIKRVNAMVHTDYKGVLMIAEDSSSFPKVTHSLENGGIGFDMKWDLGWMNDTLKFVERPAIYRKYHSNEITFGMYYNQNEQFLLPLSHDEVVHGKHSIIEKMNGDYEDKFHLARVYYSFYFAHPGKKLLFMGNEWGHIREWHEYTEMDWGLLQFPIHHSFYQMMKTLSTFYKEHDAFWKYDYQAYEKGFNWVKIDEEASLYAFSRTSDEQEILTIHNFNDQELFDVHLDLPADSEYKLVFSSNAIPMDTFSLYPDENGARITVPRLTSFYLERVK

SEQ ID NO: 9434 - protein, 715 aa, Neurospora crassa
SKKVDDLKNEFKETDKSARLTTDYGVKQTTADDWLRIVSDDKIGPSLLEDPFARERIMRFDHERIPERVVHARGSGAFGKFKVYESASDLTMAPVLTDTSRETPVFVRFSTVLGSRGSADTVRDVRGFAVKFYTEEGNWDLVGNNIPVFFIQDAIKFPDVIHAGKPEPHNEVPQAQSAHNNFWDFQFNHTEATHMFTWAMSDRAIPRSLRMMQGFGVNTYTLINAQGKRHFVKFHWTPELGVHSLVWDEALKLAGQDPDFHRKDLWEAIENGAYPKWKFGIQAIAEEDEHKFDFDILDATKIWPEDLVPVRYIGEMELNRNPDEFFPQTEQIAFCTSHVVNGIGFSDDPLLQGRNFSYFDTQISRLGVNFQELPINRPVCPVMNFNRDGAMRHTISRGTVNYYPNRFDACPPASLKEGGYLEYAQKVAGIKARARSAKFKEHFSQAQLFYNSMSPIEKQHMINAFGFELDHCEDPVVYGRMVQRLADIDLGLAQTIAEMVGGEAPTTTNHPNHGRKTINLSQTEFPPATPTIKSRRVAIIIADGYDNVAYDAAYAAISANQAIPLVIGPRRSKVTAANGSTVQPHHHLEGFRSTMVDAIFIPGGAKAAETLSKNGRALHWIREAFGHLKAIGATGEAVDLVAKAIALPQVTVSSEAEVHESYGVVTLKKVKPESFTDAVKIAKGAAGFLGEFFYAIAQHRNWDRELDGLHSMIAY

SEQ ID NO: 9435 - protein, 538 aa, Corynebacterium glutamicum
MAKLIAFDQDAREGILRGVDALANAVKVTLGPRGRNVVLDKAFGGPLVTNDGVTIARDIDLEDPFENLGAQLVKSVAVKTNDIAGDGTTTATLLAQALIAEGLRNVAAGANPMELNKGISAAAEKTLEELKARATEVSDTKEIANVATVSSRDEVVGEIVAAAMEKVGKDGVVTVEESQSIETALEVTEGISFDKGYLSPYFINDNDTQQAVLDNPAVLLVRNKISSLPDFLPLLEKVVESNRPLLIIAEDVEGEPLQTLVVNSIRKTIKVVAVKSPYFGDRRKAFMDDLAIVTKATVVDPEVGINLNEAGEEVFGTARRITVSKDETIIVDGAGSAEDVEARRGQIRREIANTDSTWDREKAEERLAKLSGGIAVIRVGAATETEVNDRKLRVEDAINAARAAAQEGVIAGGGSALVQIAETLKAYAEEFEGDQKVGVRALATALGKPAYWIASNAGLDGSVVVARTAALPNGEGFNAATLEYGNLINDGVIDPVKVTHSAVVNATSVARMVLTTEASVVEKPAEEAADAHAGHHHH

SEQ ID NO: 9436 - protein, 241 aa, Zymomonas mobilis
MTIEIVAVPAFETNYIWLLHDKVSDKTVVVDPGQAEPVLDFIQKKGWEVTQIWNTHWHNDHTGGNEVIKAETGCDVIGPSHESHPIPAIDIKVDEGDEIGLGSLVAKVMAIPAHTLGHVAYYIPDHHVLFCGDTLFAMGCGRIFEGTAEQMWQALQRFAALPPETKVYCGHEYTQDNGHFALTVDPDNQALQKRVKEVDLLRAQGKITLPTTIALEKATNPFMRAKNPEELAKLRKAKDIF

SEQ ID NO: 9437 - protein, 670 aa, Bacteroides thetaiotaomicron
MKETLNIIKNDPWLEPFADAITGRHQYALNKEAELTNKGKQTLSDFASGYLYFGLHRTPKGWTFREWAPNATHIYMVGTFNNWEEKAAYKLKKLKNGNWEINLPADAIHHGDLYKLNVYWDGGQGERIPAWATRVVQDEQTKIFSAQVWAPEKPYKFKKKTFKPTTNPLLIYECHIGMAQQEEKVGTYNEFREKTLPRIAQEGYNCIQIMAIQEHPYYGSFGYHVSSFFAASSRFGTPDELKALIDAAHEMGIAVIMDIVHSHAVKNEVEGLGNFAGDPNQYFYPAPRREHPAWDSLCFDYGKNEVIHFLLSNCKYWLEEYKFDGFRFDGVTSMLYYSHGLGEAFCNYGDYFNGHQDGNAICYLTLANELIHQVNPKAISIAEEVSGMPGLAAKVEDGGYGFDYRMAMNIPDYWIKTIKEKIDEDWKPSSMFWEVTNRRQDEKTISYAESHDQALVGDKTIIFRLIDADMYWHMQKGDENYVVNRGIALHKMIRLLTSSTINGGYLNFMGNEFGHPEWIDFPREGNGWSCKYARRQWDLVDNKNLAYHYMGDFDAEMLKVIKSVKDFQATPVQEIWHNDGDQVLAYGRKDLIFVFNFNPKQSFVDYGFLVSPGAYEVILNTDNVAFGGNGLADDSVVHFTIADPLYKKEKKEWLKLYIPARTAVVLRKKK

SEQ ID NO: 9438 - protein, 325 aa, Zea mays
IPGSTHASGYPLVDAGMRELWATGWTHNRIRVIVSSFAVKFLQIPWIWGMKYFWDVLLDADLESDILGWQYISGSLPDGHELSRLDNPEVQGQKYDPDGEYVRTWIPELARMPTEWIHSPWAAPNSILQVAGVELGFNYPKPIVELHMARECLDDAISTMWQLDTAAKLAELDGEVVDDNLNNIRNFDIPKVVLNKKLSPSTSSMEHRVLSTNGKDEKSQPTEVKALYKQIIRDDMMNDSNMDDTCSTANLKVTRKRSSSDSAFNVPSCSSSLVMESRIHHNEPSSVLYSGYFQKTADRDGTSKVEDNDSEDSGTSISRPSKKAA

SEQ ID NO: 9439 - protein, 245 aa, Putterlickia verrucosa
ALSIAGAVQSQKLAVRAISQLQSLPGGDIELLCDTVVESVRDLTGYDRVMVYKFHEDEHGEVVAESKRSDLEPYIGLHYPASDIPQASRFLFKQNRVRMIVDCHASPVRVIQDDGLMQPLCLVGSTLRAPHGCHAQYMENMGSLASLAMAVIINGNEEEAIGGRSPTRLWGLVVCHHTSARCIPFPLRYACEFLMQAFGLQLNMELQLAAQLLEKHVLKTQTLLCDMLLRDSPTGIVTQSPSIMD

SEQ ID NO: 9440 - protein, 374 aa, Quetzalia occidentalis
ALSIAGAVQSQKLAVRAISQLQSLPGGDIKLLCDTVVESVRDPTGYDRVMVYKFHEDEHGEVVAESKRPDLEPYIGLHYPAADIPQASRFLFKQNRVRMIVDCHATPVSVIQDDGLMQPLCLVGSTLRAPHGCHAQYMANMGSMASLAMAVVINGNDEEGIGGRNTTRLWGLVVCHHPSARGIPFPLRYACEFLLQALGLQLNMELQLAAQLSEKHVLRTQTLLCDMLLRDSPTGIVTQNPSIMDLVKCDGAALYYQGKYYPLRVTPTEAQIKGIVEWMLAFHGDSTGLSTDSLADAGYPGAASLGDAVCGMAVAYITNRDFLFWFRSNTAKEIKWGGAKHHPKDKDDGQRMHPRSSFKAFLEVVKSRSLPWEN

SEQ ID NO: 9441 - protein, 369 aa, Ralstonia metallidurans
MGAQTEAFLTEALFQPIKLGRIELANRMAMAPLTRSRADDDLVPTEMVVEYYRQRASVGLIIAEATQVSETAQGYTNTPGVYTPEQIAAWKTVTDAVHAQGGKIFLQIWHTGRMSHSHFQPDNQAPVAPSAIAANAKTYINGQGYVECSLPRALEASEIPEIVNDFRVAAANAIKAGFDGVEVHGAHGYLLDAFLRDGTNKRTDAYGGSIENRARFLLEVMAAVTAEIGADRVGVRLAPVSPVNDAVESNPQPLFEYVVRELEKLHPVYIHVVEGYTGGPRDNVPFDYEALHRLYSGVWMVNNGYSKEMAEEAIRAGRADMVSFGRKMITNPDLPRRFRENQPLNSPFEDASLYGGTGPHGYVDYPALA

SEQ ID NO: 9442 - protein, 374 aa, Quetzalia occidentalis
ALSIAGAVQSQKLAVCSISQLQSLPGGDIKLLCDTVVESVRDLTGYDRVMVYKFHEDEHGEVVAESKRPDLEPYIGLHYPATDIPQASRFLFKQNRVRMIVDCHATPVRVIQDDGLLQPLCLVGSTLRAPHGCHAHYMANMGSMASLAMAVIINVNDEEGIGGRNATRLWGLVVCHHTSTRCIPFPLRYACEFLMQAFGLQLNMELQLALQLSEKHVLRTQTLLCDMLLRDSPTGIVTQSPSTMDLVKCDGAALYHQGKYYPLGVTPTEAQIKDIVEWLLAFHGDSTGLSTDSLADAGYPGAVSLGDAVCGMAVAYITNRDFLFWFRSHTGKEMKWGGAKHHPEDKDDGQRMQPRSSFKAFLEVVKSRSLPWEN

SEQ ID NO: 9443 - protein, 374 aa, Unknown
  Reissantia sp. Chase 2095
ALSIAGAVQSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPVGVTPTEAQIKDIVEWLLAFHGDSTGLSTDSLADAGYPGATSLGDAACGMAVAYITNRDFLFWFRSHTAKEIKWGGAKHHPEDKDDGQRMHPRSSFKAFLEVVKSRSLPWEN

SEQ ID NO: 9444 - protein, 302 aa, Schizosaccharomyces pombe
MASTTDMSTYKLNHTMIRVKDLDKSLKFYTEVFGMKLIDQWVFEENEFSLSFLAFDGPGALNHGVERSKREGILELTYNFGTEKKEGPVYINGNTEPKRGFGHICFTVDNIESACAYLESKGVSFKKKLSDGKMKHIAFALDPDNYWIELVSQSETKPKANISNFRFNHTMVRVKDPEPSIAFYEKLGMKVIDKADHPNGKFTNYFLAYPSDLPRHDREGLLELTHNWGTEKESGPVYHNGNDGDEKGYGHVCISVDNINAACSKFEAEGLPFKKKLTDGRMKDIAFLLDPDNYWVEVIEQK

SEQ ID NO: 9445 - protein, 425 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRI

SEQ ID NO: 9446 - protein, 206 aa, Oryza sativa
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEEAFQCIVKNALKNEPEEELYVPDTVDVVGGNRAQRSSGCC

SEQ ID NO: 9447 - protein, 374 aa, Reissantia indica
ALSIAGAVQSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDRMGGRNPTRLWGLAVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATSLGDAVCAMAVAYITNRDFLFWFRSHTAKEIKWGGAKHHPEDKDDGQRMHPRSSFKAFLEVVKSRSLPWEN

SEQ ID NO: 9448 - protein, 157 aa, Carica papaya
MDVRMFVLESPILSSLRQLMELQDTETEKSFNAPTRTYVRDAKAMAATPADAKEYPNSYVFVIDMPGLKSGDIKVQVEDDNVLQISGERKREEEKDGVKYLRMERRIGKFMRKFSLPDNANTDAISAVCQDGVLTVTVQKLPPPEPKKPKTIEVKIA

SEQ ID NO: 9449 - protein, 426 aa, Zea mays
MSTTKVKRRVGKYELGRTIGEGTFAKVRFARDTVTGEAVAIKILDKEKVLRHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKILQVAPSLHMVEVRKAKGDTLEFHKFYKNLSKTLKDVVWKSDDLQTQHAS

SEQ ID NO: 9450 - protein, 480 aa, Thermosynechococcus elongatus
MSLRLFWHRRDLRLNDNLGLAAAYTRTPKVVGLFCFDPAILSASDIAAVRVAYLVGCLQALQEAYRRLGGSFLIFRGDPRQILPQVAKGLGAVAVHWHEDVEPYGRERDRAVAAALKEKGIAVETAWDQLLHPPEAIQTKQGQPYTVYSPFWRNWSSLAKPEPVSAPRHLEPLTEIEQATAGTLGAICLPTAKDLGFHWSGDLILAPGEAAAQAQLETFIDQHIQDYGEQRNYPAQPGTSLLSPALKFGVIGIRRVWTATQAAMAAARSEEAQRSIRTWQQELAWREFYQHALYWFPHLAERPHREGFATFPWLNNEAHFAAWCEGRTGYPIVDAAMRQLNETGWMHNRCRMIVASFLTKDLIINPQWGERYFMQKLIDGDLAANNGGWQWSASSGMDPKPLRIFNPASQAQKFDPEAEYIRRWLPEVRSLDTIDLVTGNISPLERHRCGYPLPIVDHRQQQQRFKQLYQEHFRSPIPQE

SEQ ID NO: 9451 - protein, 243 aa, Zea mays
MRVAPATRTAAAAHPPSAFLLLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKEGGHEPGWREVPVEDPVVKDAAHHAVKSIQERSNSLFPYELLEILRAHAQVVEDFAKFDILMKLKRGSKEEKIKAEVHKSLEGAFVLNQHQPAEHAESSSQ

SEQ ID NO: 9452 - protein, 491 aa, Raphanus sativus
MDPYKYRPASSYNSPFFTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDKFDFDPLDVTKTWPEDLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPSI

SEQ ID NO: 9453 - protein, 285 aa, Pseudomonas fluorescens
MAWLTVATPAVGTVVALVLAWHQGIGWLEIGALASMYLLTALGVEVGMHRFFSHHAFKAGPVITAFFGIAGSMAAQGPILFWAATHRQHHAFTDKEGDPHSPRPLKAGFIGNIQGWWHAHLGWLFSLRKQNWSQFVPDLLRDRLIMQINQRYYLWIILGLLLPSLACGLITRSWEGALSGLLWGGFVRIFLVDHATWCINSFAHRVGGRDHKTRDTSRNVFWLAIPTVGGGWHNNHHAFPALAHAGLKPWQLDIGGLFIELLALCGLAWDVKRPGPTVAAEPSES

SEQ ID NO: 9454 - protein, 318 aa, Pseudomonas fluorescens
MDEILTNTATPEVGGVAQLSPSAARTKARIALAVMLVPLFGTLEAIRLWFTGQVHALDFILFAVFYAVQMFGVSMGYHRYLAHRAFKTSRLMSSLMLIAGCMAAQGPILFWVTTHRRHHTYSDQHGDPHSPNLMGQSRWQRAKGLWHAHMPWMLAPDMSSWNFFAPDILRDRRLFFYNQTYLFWVALGVILPGVIGGLVSQSWSGAWSGLIFGGLARIFVANQAAWCVGSICHRYGARPFVTHDQSTNNWIVAFLTFGEGLQNNHHAFPAWYRHGVHWWEPDLSGWTLALMGKLRLVSDLRSPSQAMIDKVRKRQASS

SEQ ID NO: 9455 - protein, 310 aa, Yarrowia lipolytica
MSLTTSTITLNDGRAMPALGLGTFQNDACEQVVYDAIKAGYRHIDTAFIYRTEEAVGNAVERAISDGIVARSDLWITTKVWPTYHDRVPQSVDKSLALLKTDYIDLLLVHWPVALNGDPNDDYSFLPKREDGEIDITEGDDWISFYKQLETEQKTGRVKSIGVSNVSSVYLERLLEHASVIPAVNQFENHPLLPQKDQIEANLKQGIQITAYSPLGSGQGVINLHENPTIVELAEKYNTSTASILINWHICQGRSVIPKTANSLRVVSNAVKVEISAQDLAKIDAISAEHGTHRTVPFHLFKKDCLGYPV

SEQ ID NO: 9456 - protein, 877 aa, Phaeosphaeria nodorum
MSAAIDNEDLEELSISMPHPRRGGPSTTKAVDFTTPPVAPPTVMQASKSRDSKASQRLGQYTIVKTLGEGSFGKVKLATHQVSGQKVALKIINRKRLVTRDMAGRIEREIQYLQLLRHPHIIKLYTVITTPTEIIMVLEYAGGELFDYIVNNGRLQEDKARKFFQQIVCAVEYCHRHKIVHRDLKPENLLLDDQYNVKIADFGLSNIMTDGNFLKTSCGSPNYAAPEVISGKLYAGPEVDVWSCGVILYVLLVGRLPFDDEYIPTLFKKIAAGNYSIPSYLSPGAVSLIKKMLMVNPVHRITIGEIRMDPWFTKDIAPYLEPPVQEFFDSGVDPHKAIDPTAIAPAIPAPVVQKLHDTVVTKLGKTMGYAEHDVQEALARDEPSAIKDAYLIVRENQMMKVNPLMTQESQLAPFLAQSPPTHHESYLGSSIPQILNSSSPPKGIPSQAQDQHERARHGSNASSQLASVRSPVSTVAILPSSLTEYHKAYMKGHPRPPFKPEHDGLPPTPDQTEEQRQISARRLKPNFRALPDTTRNRPEPMTSLPAKKPRPTKWQFGIRSRNQPAEAMLAIFKALKAMGADWEVPKIRKAGGKGGSRSPTGSHASQERSRSRSRSRSRSPGSSVSSHDSGDEKKTGSDSPTHEPLTVRNADSGEQRGRQRKHYNHTNDWGYHIPEDPWVINARFRKDGMFPPGVAHPSSTHSSRVDLANDPSGLRRRSSTNTSTTSLSHHIDSMTITDRPNSISGEDHPEADEAVYIYVSIQLYSIDREFFVVDFKCAGYERLVSNLVREVKAASSSSPQHQHEDGWDDEAGVWRRLDEGEPLPDDLAKELRDGGKGVLRERTEEVGAGRKEGEKVVTSPFPFLDVASTLILQLSGE

SEQ ID NO: 9457 - protein, 514 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNETAASPVGQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYKTREEKYLLDLQRIQGPQFLFLDLCAAFLAQLRVL

SEQ ID NO: 9458 - protein, 400 aa, Saccharomyces pastorianus
MSFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVQLWVLGWAAFPDNLARDGLRYDSASDNVFMDAEQEAKAKKANNPQHSLTKDEIKQYIKEYVQAAKNSIAAGADGVEIHSANGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKK

SEQ ID NO: 9459 - protein, 484 aa, Listeria innocua
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRQVIEDFTNYSALLFERFNGRVKYWVTLNEQNVFISHGYKLAYHPPGVSDDKRMFAANHNANLANASAIAKFRELGISGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 9460 - protein, 738 aa, Unknown
  Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPVINQVFSTNRAVKISPNSPVARLRPAGKYMPGEVVAVRVPLLHLSNFQINDWPELSTKRYALMVLMLPSDSARQWHAHVLELVEVVADQVAVALSHAAILEESMRARDLLMEQNVALDLARREAETAVRARNDFLAVMNHEMRTPMHALIALSSLLQETELTPEQRLMVETILKSSNLLATLINDVLDLSRLEDGSLQLDIGTFNLHALFREVLNLIKPIASVKKLFVTLSLSSDLPEFAIGDEKRIMQVLLNVIGNAVKFSKEGSVSVSAVAAKSESLRDPRAPEFFPVQSENHFYLRVQVKDTGSGISPQDIPKLFNKFAQNQALATKNSGGSGLGLAICKRFVNLMEGHIWIESEGLGKGCTAVFVVKLGIPGRSNESKLPFMPRLPPNHMQMIFQGLKVLVMDDNGFSRMVTKGLLVHLGCDVTTVASGDECLRVLAQEHRVVFMDVSIPGIDCYEVAVRIHEKFNKRHDRPHIVALTANTDRVIKENCMRAGMDGVILKPVSVDKMRSVLSELLEHGVVLQS

SEQ ID NO: 9461 - protein, 245 aa, Rzedowskia tolantonguensis
ALSIAGAVQSQKLAIRAISQLQSLPGGDIKLLCDTVVESVRELTCYDRVMVYKFHEDEHGEVVAESKRPDLEPYIGLHYPATDIPQASRFLFKQNRVRMIVDCHASPVRVIQDDGLMQPLCLVGSTLRAPHGCHAQYMENMGSKASLAMAVIINGNDEEVIGGRNATRLWGLVVCHHTSARCIPFPLRYACEFLMQAFGLQLNMELQLAAQLSEKHVLKTQTLLCDMLLRDSPTGIVTQSPSIMD

SEQ ID NO: 9462 - protein, 738 aa, Unknown
  Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPVINQVFSTNRAVKISPNSPVARLRPAGKYMPGEVVAVRVPLLHLSNFQINDWPELSTKRYALMVLMLPSDSARQWHAHELELVEVVADQVAVALSHAAILEESMRARDLLMEQNVALDLARREAEMAVRARNDFLAVMNHEMRTPMHAIIALSSLLQETELTPEQRLMVETILKSSNLLATLINDVLDLSRLEDGSLQLDIGTFNLHALFREVLNLIKPIASVKKLFVTLSLSSDLPEFAIGDEKRIMQVLLNVIGNAVKFSKEGSVSVSAVAAKSESLRDPRAPEFFPVQSENHFYLRVQVKDTGSGISPQDIPKLFNKFAQNQALATNNSGGSGLGLAICKRFANLMEGHIWIESEGLGKGSTAVFVVKLGIPGRSNESKLPFMPRLPPNHMQMTFQGLKVLVMDDNGFSRMVTKGLLVHLGCDVTTVASGDECLRVLAQEQSVVFMDVSIPGIDCYEVAVRIHEKFNKRHDRPLIVALTASTDRVIKENCMRAGMDGVILKPVSVDKMRSVLSELLEHGVVLQS

SEQ ID NO: 9463 - protein, 245 aa, Salacia impressifolia
ALSIAGAVQSQKLAVRAISQIQSLPGGDIKLLCDTVVESVRDLTGYDRVMVYKFHEDEHGEVVAESKRPDLEPYIGLHYPATDIPQASRFLFKQNRVRMVVDCNASPVRVIQNDGLMQPLCLVGSTLRAPHGCHAQYMENMGSIASLAMAVIINGNDEEVIGGRNPTRLWGLVVCHHTSARCIPFPLRYACEFLMQAFGLQLKMELQLAAQLLEKHVLKTQTLLCDMLLRDSPTGIVTQSPSIMD

SEQ ID NO: 9464 - protein, 569 aa, Porphyromonas gingivalis
MKKTNLFLSLLVIFITGSFMTACAQKSKTNKLTEEDRSRNEYVQSMDVLSNIIGNVRLYFVDTISIKHMTRRGIDAMLGGLDPYTEYIPYEEMDELKLMTTGEYAGVGAIISQRPDSAVIIQRPMEGMPADEAGLIAGDRILTIDGKDFRKSTTPKVSQALKGIAGTVAKVTVMRYGETKPRTFSVKRQKVIMNSVTYSGMLDGSIGYIRLNNFTDKSAEEVRTALLDLRDKQGAKGLILDLRGNGGGLMQAAIEIVNLFVPKGKEVVTTKGRIAESASVFRTLTEPIDTKLPIVVLIDGQSASSSEIVAGALQDMDRAVLMGQKSYGKGLVQTTRQLPYNGVIKLTTAKYYIPSGRCIQRLDYSRTNRTGMATAIPDSLHKIFYTAAGRRVEDAGGILPDIEVKQDTAATLLYYMAINNDVFDFVTGYVLKHKTIAKPEDFSITNEDYAAFCKMMEEKKFDYDRQSGKMLDKLEELAKIEGYLPEANSELKALREKLKPNLSRDLLRFKKEITNYLNNEIVTRYYYERGSIRQSLPEDKVVKEAIKLLKDHPEQIRQILAAPKAENKG

SEQ ID NO: 9465 - protein, 753 aa, Unknown
  Petunia x hybrida
MGSLLRMNRLLTSIVDSCNCIDPQLPADDLLMKYQYISDFFIALAYFPIPVELIYFVKKSAVFPYRWVLVQFGAFIVLCGATHLINLWTFSMHTRTVAVVMTTAKVLTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNRAVKISPNAPVARLRPTGKYMPGEVVAVRAPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLLLDIGTFNLHALFREVLSLIKPITSVKKLFATLSLSSDLPEYVIGDEKRLMQILLNVVGNAVKFSKEGSVSISAFVAKSESLRDPRAPEFFAVPSENHFYLRVQVKDTGVGINQQDIPNLFSKFAQSEALTTKNSDGSGLGLAICKRFVNLMEGHIWIESDGLGKGCTAIFIIKLGIPGRPNESKLPLMSKLTANELQMTFHGLKVLVMDDNGVSRMVTKGLLAHLGCDVTTVGSRDECLRVVSQEHKVVFMDVSMQGIDCYEVAVLIHERFGKHHGRPLVVELTGNTDSVTKENCMRVGMDGVILKPVSVDKMRSVLSELLEHGVVLQS

SEQ ID NO: 9466 - protein, 245 aa, Salacia impressifolia
ALSIAGAVQSQKLAVRAISQIQSLPGGDIKLLCDTVVESVRDLTGYDRVMVYKFHEDEHGEVVAESKRPDLEPYIGLHYPATDIPQASRFLFKQNRVRMIVDCNASPVRVIQDDGLMQPLCLVGSTLRAPHGCHAQYMENMGSIASLAMAVIINGNDEEVIGGRNPTRLWGLVVCHHTSARCIPFPLRYACEFLMQAFGLQLKMELQLAAQLLEKHVLKTQTLLCDMLLRDSPTGIVTQSPSIMD

SEQ ID NO: 9467 - protein, 205 aa, Aspergillus parasiticus
MSSRKKVLLKVIILGDSGVGKTSLMNQYVNKKFSASYKATIGADFLTKEVLVDDRLVTMQIWDTAGQERFQSLGVAFYRGADCCVLVYDVNNSKSFEALDSWRDEFLIQASPRDPENFPFVVIGNKIDVEESKRMISSKRAMTFCQSKGNIPYFETSAKEAVNVEQAFEVIARSALAQEEAEEFSGEFSDPINIHLDSERDGCAC

SEQ ID NO: 9468 - protein, 361 aa, Salacia nitida
QSQKLAVRAISQIQSLPGGDIKLLCDTVVESVRDLTGYDRVMVYKFHEDEHGEVVAECKRPDLEPYIGLHYPATDIPQASRFLFKQNRVRMIVDCHASPVRVIQDDGLMRPLRLVGSTLRAPHGCHAQYMENMGSIASLAMAVIINGNDEEVIGGRNPTRLWGLVVCHHTSARCIPFPLRYACEFLMQAFGLQLKMELQLAAQLLEKHVLKTQTLLCDMLLRDSPTGIVTQSPSIMDLVKCDGAALYFQGNYYPLGVTPTEAQIKDIVEWLLAFHGDSTGLSTDSSADAGYPGAALLGDAVCGMAVAYITNRDFLFWFRSHTAKEIKWGGAKHHPEDKDDGQRMHPRSSFKAFLEVVKRRS

SEQ ID NO: 9469 - protein, 683 aa, Glomus intraradices
MSPTEMISQENYEPGICKIDPWLKPFAPAIKRRLESYKKWVKEINQNEGGYDKFSRGYERFGLNVLPNGDIIYREWAPNAVAASLIGEFNDWDRSKHPMKKDSFGVWEVHIPAKNGIPTIPHNTKIKISMTTPEGECIDRLPAWIKRVTQDLNVSLAYDAIFWNPPQKYQWKNNSPKKPTSLRIYEAHVGISTNEGRVGTYNEFTDNVLKRIKDLGYNAIQLMAIMEHAYYASFGYQVTSFFGVSSRYGTPEELMRLIDTAHGMGLYVLLDVVHSHACKNVLDGLNMFDGSDHCYFHEGGKGRHDLWDSRLFNYGHWEVLRFLLSNLRFFMEEYRFDGFRFDGVTSMMYHHHGIGTGFSGGYHEYFGDTVDEGGVVYLMLANDMLHKLYPRIITVSEDVSGMPGLCLPVEEGGIGFDYRLAMAIPDMWIKLLKEQRDDDWDMGNICWTLTNRRHMEKTIAYAESHDQALVGDKNTCLLVNGQGMYTHMSDMTPLTPIIDRGLALHKMIRLLTHGLGGEGYLNFEGNEFGHPEWLDFPRAGNNNSFHYARRQWNVVDDDLLRYKYLNEFDKAMQHLEEQYGWLSSPQAYISLKHNENKLVAFERGNLLWIFNFLPTQSFADYKIGTEWAGKYSIALNTDRKIFGGHDRIDESISYHSQPHEWDGRKNYIQVYIPCRVAPVLSHC

SEQ ID NO: 9470 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCSHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 9471 - protein, 514 aa, Caulobacter crescentus
MSDSRSDDRHPSVTPEQLATLSHEFRTPLNGVLGMARLLENTKLTAEQRSYVTALRESGDHLLSLVNDVLHFARLGAAAIELSLAPVDIEGLLRQVAELMSPRAHEKGIEIAWAVSSPLPTILADEGRLRQILLNFAGNAVKFTEAGGVLLTASAIDGGRVRFSVADTGPGVAPDARARIFEAFVQTDVTHATQLGGAGLGLAIVSRLSAAMGGAVGVGGELGQGAEFWFEAPFATAAAPLRAAPLEGRNVAIASPNAIVRAATARQIEAAGGRAYAAVDIASALAGAPADAVLLIDAALSGPRGALKPPAGRRSVVLLTPEQRDRIDRLKAAGFSGYLIKPLRAASLVAQVLQAVTADGVAEDEPAHDDRIAGAVASGARVLLAEDNPINALLARTLLEREGCIVDRVADGEQAIAAASAGVYDLILMDLRMPGLTGIEAARALRAKGVATPIAALTADAFDEDRRTCLAAGMDDFLVKPLTQEALRDALKRWTTGGVSGGWTKPATRAKVAG

SEQ ID NO: 9472 - protein, 665 aa, Bacillus anthracis
MNKKMEQLKHPVTDNQRKHALTTNQGVKIAEDEFSLKMGLRGPTLMEDFHFREKMTHFDHERIPERIVHARGVGAHGYFQLYESLEAYTKADFLTNPSKKTPVFVRFSTVQGSKGSNDAVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINKEGKAHFVKFHWKPALGVHSLVWDEAQKIAGKNPDFHRQDLYEAIEKGDYPEWELGLQLIPEEDEHTFDFDILDPTKLWPEEEVPVKLVGKMTLNKNVDNFFAETEQVAFHPGHVVPGIDFSNDPLLQGRLFSYTDTQLSRLGGPNFHQTPINQPVCPFHNNQRDGMHQMQIHRGQTSYHPNGLNDNQPATVQAEQGGYEHYQEKIDGHKIRGRSKSFLNFYSQAKLFYNSMSPIEKQHIKEAFCFEVGKCKSDMVKANVIALLNHVDRQLAQEVANIIGAPLPKENHEVNSDAKSPALSMSNTIFKADSKNVAIVLNGDPSVSLLSEWIQAFAQHRINYSIVDNKIYQFNNSIKVTDTYTTTDSSLFDAVLVFSSESAIHPPVLEFAETTFKHFKPIAHVLSNPHALDNSKIKLDGAGIYNLANTSIESFIEGIAQGRFWNR

SEQ ID NO: 9473 - protein, 782 aa, Unknown
  Bradyrhizobium sp. BTAi1
MKIAIIGGGPAGLYAAILLKKQRPSADIAVYERNRPDDTFGFGVVFSDATLDNFEKYDLPSYQRITQEFAYWDDIAVHFRGTVHRVGGNGFCGCSRRTLLMILQERARELGVTLQFEVDIDNEALFAGADLILLSDGINSRFREKHVEHFQPEVDLRANKFAWMGSTKPLDAFTFIFQETEWGPFIAHAYQYEAGHSTWIFETDPATFERAGLTGLDERQSADRMKEIFGWFLGDHPLLINRSMWRNFPMIRNKRWVKDNMVLLGDAKSTAHFSIGSGTKLAMEDAIALADAMARAPSIAAALELYENGRREEVEKIQHAADVSLVWFEHVDRFWDFDPVQFAFGVMTRSKAITYDNLTLRAPDFVAEVDKAFARQVHAKGFDVDVDKPVAPMFQPLKLREMTVVNRAVLSPMCMYSAEEGIPGDFHLVHYGSRAIGGAGLLFTEMTCVSRDARITPGCAGLWNDAQEAAWTRIVDFVHANSQAKFALQLGHAGRKGATKLMWDGMDRPLEQGGWEVVSASPLPYFPDSQVPRELDRASMDAIKADFVAAAERGHACGFDMLELHCAHGYLLASFISPLTNRRTDDYGGSLENRLRFPLEVFAAMRAAWPAHKPMSVRISATDWAEGGITGDDAVLIARAFGEAGVDLVDVSTGQTVREAKPIYGRMFQTPFSDQVRNEAHVATMCVGNITSADQVNTILAAGRADLVALGRPHLVDPAFTMKAAAWYGADMFCPPQYLPGKEQIFRNSVRDRLDFEELKIKAKPKTRAELRAEAAKPLAAE

SEQ ID NO: 9474 - protein, 442 aa, Oryza sativa
  misc_feature (320)..(320): Xaa can be any naturally occurring amino acid
MSSGGGRPPAAQHIVRSVRQRFVPLPPPLARAPFAAAPGDYHRFAAASRGGEIEEGIVIRRTPLKRKTPCGESEAAESSERMMTSPGFTEGVGSPLMTPVSGKTSRTTKSMAKFNKAGPQTPISNAGSPGNPSTPASSRYDNSLGLLTRKFINLLKQTQDGILDLNDAAKILDVRKRRIYDITNVLEGTGLIEKKLKNRIRWRGSDDSGTNLDSDISCLKTEVENLYIQEQALDRSISEIREKMEELTEDESNHRWLFVTEDDIKGLPCFQNEALIAIKGPRGTTVEVPDPDEAGDYLQRRYRILLRSTMGPIDIYLVRXHFILLLKHEAQKKLSDEHPYYIISQYKKMEELGETATPPRHASVVEPPSIATEAGHSSKQTMPLNVQQDIQETPELNASRAFGRMKKITPSDVDTDADYWLLTDDDISITHMWTTACILDEI

SEQ ID NO: 9475 - protein, 369 aa, Unknown
  Halobacterium sp. NRC-1
MQELSPAELGEQVQDDDGPLVLDIRHEEDFQEWHIPGSRNVDVYDELTDDPEQAIEPLDDLPSDEQIVTVCAAGVVSQTATAVLRELGYDAVTLTDGMNGWSRVHRHAELPVDVDGTLVQVARPGKGCLSHVLVSDGEAAVFDPSHYLNEYDTVLDEYDAELVGVFDTHAHADHVSGAADLADRHDVPYYLHQKDALAVDATPLEDGQTVTVGRLDIEVIHTPGHSEGSVSFDVEGAALLTGDTLFHDSVGRVELGVEAGIEDADVEGNAATLYESLQRLLDRPDDALVLPAHDPGSPEPPVAATLAEVRERNDDLGRDREAFVEELASDIPDHPPNFERVKRTNVGQESVPEEELAELELGPNNCAAE

SEQ ID NO: 9476 - protein, 272 aa, Zea mays
SLPCAVTSMELLHAVIHGAATTTTTTTTTTTSSSATVTSGDEGAHLPQGWAKKKRSRRQRSEEENLALCLLMLSRGDRHRVQAPPPPVPSAEFRCSVCGKSFGSYQALGGHKTSHRVKLPTPPAAHVQLPAPPAVALLVEAPAPPPVTATPPPLPLVAVAVAVREPATSSTSDGAAAGRVHRCTICHKEFPTGQALGGHKRKHYDGGAAAAETSEVGSSGNGSSAARAFDLNLPAVPEFAFRCGAKPGKMWDEDQEVQSPLAFKKPRLLMTA

SEQ ID NO: 9477 - protein, 513 aa, Triticum aestivum
HDRTSLYKKAGWYRSGIPGISSTHASAHASGGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDTSLGQKLASRLKIKPSM

SEQ ID NO: 9478 - protein, 227 aa, Zymomonas mobilis
MPTTSHSGKMPLEATVIPVTPLRQNCSLLYCVETMKGAIVDPGGDIPLILDSITKKQVTVEKILITHGHFDHCGGAAALSQILGCPIIGPHPDDQFWIDQIPENAQQYGFEGESFTPDQWLKDKDEITLGEERLLVRHCPGHTPGHVVFYNAASHLAIVGDVLFRNSIGRSDFAGGDHQALIQSITEKLWPMGRETVFIPGHGRPSTFGAERDHNPFVADSVLGLMP

SEQ ID NO: 9479 - protein, 545 aa, Shewanella oneidensis
MAAKEVVFGNDARVKMLAGVNILANAVKVTLGPKGRNVVLDKSFGSPLITKDGVSVAKEIELEDKFENMGAQMVKEVASKANDAAGDGTTTATVLAQAIVTEGLKAVAAGMNPMDLKRGIDKAVIAAVAELKNLSQDCADSKAIAQVGTISANSDESIGQIIATAMEKVGKEGVITVEEGQALENELDVVEGMQFDRGYLSPYFINKPETGSVELDHPFVLLVDKKISNIRELLPILEGLAKTGKPLLIVAEDVEGEALATLVVNNMRGIVKVAAVKAPGFGDRRKAMLQDVAILTGGTVIAEEIGLELEKATLEDLGTAKRVVITKDNTTIIDGNGEQAQIEARVSQIKQQIEESTSDYDKEKLQERMAKLAGGVAVIKVGAATEVEMKEKKARVEDALHATRAAVEEGVVPGGGVALIRVASKIADVEVANEDQKHGVVIALRAMEAPLRQIATNAGEEASVVANNVKNGSGNYGYNAGNDTYGDMLEMGILDPTKVTRSALQFAASIAGLMITTEAMVAELPKADAPDMGGMGGMGGMGGMM

SEQ ID NO: 9480 - protein, 212 aa, Bacteroides fragilis
MKIKRFEFNMFPVNCYVLWDETNEAVVIDPGCFYDEEKQALKNFIVTNNLNIKHLLNTHLHLDHIFGNPFMLREFGLSAEANQADEYWIDEAPKQSRMFGFQLNEAPVPLGKYLHDGDIITFGNTTLEAIHVPGHSPGSLVYYCRADNCMFSGDVLFQGSIGRADLAGGNFDELKEHICSRLFVLPNETIVYPGHGAPTTIGIEKAENPFFR

SEQ ID NO: 9481 - protein, 1307 aa, Magnaporthe grisea
MADAATLAAVAAIVENIATNSGAPGKNASFRSSTYVQLPGPESDEKKQLERELAALVIRVQQLETRANAAPATIFPDTPNETAHSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNVNVMAQNLTDQVREIASVTTAVAHGDLTQKIESAAKGEILQLQQTINTMVDQLRTFASEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 9482 - protein, 472 aa, Spinacia oleracea
MATAVSTVGAATRAPLNLNGSSAGASVPTSGFLGSSLKKHTNVRFPSSSRTTSMTVKAAENEEKNTDKWAHLAKDFSDDQLDIRRGKGMVDSLFQAPADAGTHVPIQSSFEYESQGLRKYDIDNMLGDLYIAPAFMDKLVVHITKNFLNLPNIKIPLILGVWGGKGQGKSFQCELVFAKLGINPIMMSAGELESGNAGEPAKLIRQRYREAADLIAKGKMCALFINDLEPGAGRMGGTTQYTVNNQMVNATLLNIADNPTNVQLPGMYNKQDNARVPIIVTGNDFSTLYAPLIRDGRMEKFYWAPTREDRIGVCTGIFKTDKVPAEHVVKLVDAFPGQSIDFFGALRARVYDDEVRKWVNSVGVDNVGKKLVNSKDGPPVFEQPEMTLQKLMEYGNMLVQEQENVKRVQLADQYMSSAALGDANKDAIDRGTFFGKAAQQVSLPVAQGCTDPEAKNYDPTARSDDGSCTYNL

SEQ ID NO: 9483 - protein, 173 aa, Anabaena variabilis
MMRTNERLKPGSDSQENLRGVKDMTIIRWNPWQDLNTLQRQLNHLFEEDMLPSTVLERTLTRVPAAEIHETAEAIHLKLELPGIDAKDVDLQVTDKAVYISGERKSETKTEDKGVVKSEFQYGKFQRVIPLPTRIQNTNVKAEYKDGILNLTLPKAEAEKNKVVKVNIESAVG

SEQ ID NO: 9484 - protein, 830 aa, Solanum tuberosum
VLTDDNSTMAPLEEDVKTENIGLLNLDPTLEPYLDHFRHRMKRYVDQKMLIEKYEGPLEEFAQGYLKFGFNREDGCIVYREWAPAAQEAEVIGDFNGWNGSNHMMEKDQFGVWSIRIPDVDSKPVIPHNSRVKFRFKHGNGVWVDRIPAWIKYATADATKFAAPYDGVYWDPPPSERYHFKYPRPPKPRAPRIYEAHVGMSSSEPRVNSYREFADDVLPRIKANNYNTVQLMAIMEHSYYGSFGYHVTNFFAVSSRYGNPEDLKYLIDKAHSLGLQVLVDVVHSHASNNVTDGLNGFDIGQGSQESYFHAGERGYHKLWDSRLFNYANWEVLRFLLSNLRWWLEEYNFDGFRFDGITSMLYVHHGINMGFTGNYNEYFSEATDVDAVVYLMLANNLIHKIFPDATVIAEDVSGMPGLGRPVSEGGIGFDYRLAMAIPDKWIDYLKNKNDEDWSMKEVTSSLTNRRYTEKCIAYAESHDQSIVGDKTIAFLLMDKEMYSGMSCLTDASPVVDRGIALHKMIHFFTMALGGEGYLNFMGNEFGHPEWIDFPREGNNWSYDKCRRQWNLADSEHLRYKFMNAFDRAMNSLDEKFSFLASGKQIVSSMDDDNKVVVFERGDLVFVFNFHPKNTYEGYKVGCDLPGKYRVALDSDAWEFGGHGRTGHDVDHFTSPEGIPGVPETNFNGRPNSFKVLSPARTCVAYYRVDERMSETEDYQTDICSELLPTANIEESDEKLKDSLSTNISNIDERMSETEVYQTDISSELLPTANIEESDEKLKDSLSTNISNIDQTVVVSVEERDKELKDSPSVSIISDVVPAEWDDSDANVWGED

SEQ ID NO: 9485 - protein, 364 aa, Salacia nitida
VQSQKLAVRAISQIQSLPGGDIKLLCDTVVESVRDLTGYDRVMVYKFHEDEHGEVVAECKRPDLEPYIGLHYPATDIPQASRFLFKQNRVRMIVDCHASPVRVIQDDGLMRPLRLVGSTLRAPHGCHAQYMENMGSIASLAMAVIINGNDEEVIGGRNPTRLWGLVVCHHTSARCIPFPLRYACEFLMQAFGLQLKMELQLAAQLLEKHVLKTQTLLCDMLLRDSPTGIVTQSPSIMDLVKCDGAALYFQGNYYPLGVTPTEAQIKDIVEWLLAFHGDSTGLSTDSSADAGYPGAALLGDAVCGMAVAYITNRDFLFWFRSHTAKEIKWGGAKHHPEDKDDGQRMHPRSSFKAFLEVVKRRSLP

SEQ ID NO: 9486 - protein, 238 aa, Lycopersicon esculentum
MADPDTTRTVVGIIGNVISFFLFLSPGPTFVQILKAKSVMEFKPDPYIATVLNCAVWVFYGMPFVHPDSLLVITINGFGLAIELLYVSIFFIYSDWSKRQKIIIALVIEAIFMAILIFVTLTFLHGTKDRSMLIGIVAIVFNIIMYTSPLTVMKKVITTKSVKYMPFYLSLANFANGIVWACYALLKFDPYILIPNGLGSLSGLVQLILFAAFYRTTNWDEDEKEVELSTSKSNKSDV

SEQ ID NO: 9487 - protein, 374 aa, Salaciopsis glomerata
ALSIAGAVQSQKLAVRAISQLQSLPGGDIKLLCDAVVESVRDLTGYDRVMVYKFHEDEHGEVVAESKRSDLEPYIGLHYPATDIPQASRFLFKQNRVRMIADCHASPVRVIQDDGLMQPLCLVGSTLRAPHGCHAQYMENMGSVASLAMAVIVNGNDEEVIGGRNATRLWGLVVCHHASVRCIPFPLRYACEFLMQAFGLQLNMELQLAAQLSEKPVLKTQSLLCDMLLRDSPTGIVTQSPSIMDLVKCDGAALYYQGNYYPLGVTPAEPQIKDIVGWLLAFHGDSKGLSTDSLADAGYPGAALLGDAVCGMAVAYITNRDFLFWFRSHTAKEIKWGGAKHHPEEKDDGQRMHPRSSFKAFLEVVKSRSFPWEN

SEQ ID NO: 9488 - protein, 369 aa, Schaefferia frutescens
ALSIAGAVQSQKLAIRSISQLQSLPGGDIKLLCDTVVESVRELTGYDRVMVYKFHEDEHGEVVAESKRPDLEPYIGLHYPATDIPQASRFLFKQNRVRMIVDCHASPVLVIQDDGLMQPLCLVGSTLRAPHGCHAQYMENMGSKASLAMAVIINGNDEEVTGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPAEAQIKDIVEWLLAFHGDSTGLSTDSLADAGYPGATLLGDAVCGMAVAYITNRDFLFWFRSHTTKEIKWGGAKHHPEDKDDGPRMHPRSSFKAFLEVVKSRS

SEQ ID NO: 9489 - protein, 309 aa, Schaefferia frutescens
ALSIAGAVQSQKLAIRSISQLQSLPGGDIKLLCDTVVESVRELTGYDRVMVYKFHEDEHGEVVAESKRPDLEPYIGLHYPATDIPQASRFLFKQNRVRMIVDCHASPVLVIQDDGLMQPLCLVGSTLRAPHGCHAQYMENMGSKASLAMAVIINGNDEEVTGGRNCTRLWGLVVCHHTFARCIPFPLRYAWEFLMQAFGLQLNMELQLAAQLSEKHVLKTQTLLCDMLLRDSPTGIVTQSPSIMDLVKCDGAALYYQGKYYPIGVTPAEAQIKDIVEWLLAFHGDSTGLSTDSLADAGYPGATLLGDAV

SEQ ID NO: 9490 - protein, 150 aa, Zea mays
  misc_feature (32)..(32): Xaa can be any naturally occurring amino acid
CTKYYQQESSKLRQMIHSLQNANTLTCLDGLXRNIVGDSIHTMGLRDLKQMEGKLEKAIIKIRARKNELLYAEVDYMQKREMDLQTDNMYLRSKIAESNETGQPAMHMMGVPPPTSEYDHMAPFDSRNFLQVSMPQHYSHQLQPTTLQLG

SEQ ID NO: 9491 - protein, 488 aa, Listeria innocua
MTERKNLTTNQGTPVGDNQNSMTAGLKGPTLLEDYVLIEKLAHFDRERVPERVVHARGAGAHGKFVTKKSMKKYTIANFLQEEGTETEVFARFSTVIHGQHSPETLRDPRGFSVKFYTEEGNYDFVGNNLPVFFIRDAIKFPDVIHSLKPDPRTNIQDGNRYWDFFSLSPEATTMIMYLFSDEGTPASYREIRGSSVHAFKWINEEGKTVYVKLRWVPKAGIVNLSTEQAAQIQAKEFNHASRDLYEAIENGDYPEWDLYVQVLDPKDLDSFDFNPLDATKDWFEDVFPYEHVGTMTLNRNPDNIFAETESVGFNPGVLVRGMLPSEDRLLQGRLFSYSDTQRHRVGPNYLQLPINSPKAPVANNQRDGYMPFKQQTSSINYEPNSYETEPKENPAFIEQEQEIRGDISGRLIAEKPNNFGHAKEVWDRYSDAERAALVKNIVDDWSGVRDDIKIRNLRNFYQIEPEFANRVADGTGINLEEHVADLK

SEQ ID NO: 9492 - protein, 456 aa, Oryza sativa
MARRAREEEADQVERKLVLGRYELGRLLGQGTFAKVYYGRDLRSGESVAIKVIDKARLRRTEGMVEQLRREISIMRMVRHPNVVGIREVLASRARVFVVMEYARGGELFAKVARGRLTEEHARRYFQQLVAAVGFCHGRGVAHRDLKPENLLLDEEGRLKVTDFGLAALPEQLRQDGLLHTQCGTPAYVAPEVLRKRGYDGARADLWSCGVVLYVLLCGFLPFQHENYAKMYQKIFKAEYQVPPWVSGDARRLIVRLLVVDPAKRISIPEIMRTPWFKKGFVPPVPTSPVSPKKWEEDDVLLDGGDSGAMSPRTCNAFQLISSMSSGFDLSGMFESEQKAATVFTSRAPAATVIQKLEAVGRSLGYSATRGKGWKLRLEATADGANGRLAVTVEALEVAADVAVVEFAHDAGDELEFNKFCAVDVRPGLADIVWAWQGDRPAAPDVAAATVECSPA

SEQ ID NO: 9493 - protein, 1233 aa, Neurospora crassa
MDNRTGSRVSVRQPLGDATNRANIAAMQTSSRPKLEANAKSWKNTNRSKSNPPIITDIPLVQHHIVTIPSPVAVPDVPSMSRLRHPSSLQQMNTQASDARRVSQFSNVSSNASITRLQKTHIGPWQLGKTLGKGASARVRLARHRTTHQLVAIKIVAKSTAHVTQATSMANLDRVDYRKPSISTDGVRRMPLAIEREVAILKLIQHPNIIKLHDIWENRQDIYLVTEYVEKGDLFDFINWNGSLNEEEAIFYYRQIMSALEYCHSFNICHRDLKPENILLKADGQIKIADFGMAALHQEPTHHLKTACGSPHYAAPELLKHQPYKGSAVDIWAMGVILFAMLAGRLPFDDSDMDAMLQRARKGYYKMPSELSREAKDLIRKILVVNPLQRITMKQMWKHPLIKKYDYVDDYQQSDGQPQDVLRNADIGPIPEKEVDPQILRQLKAMWHAYSEAQIKEKLGQTKPNDQKVFYWLLYRHRHAQLENYNNDIPISKSDFHHLKPPNWGKRISTCEFTQSSRNGHGRSISKFTVISNVAEVNDSGTVRSYDPYRASQVLRNCASEASHARIIVHRNPSEPGTRSNTSNIAHSYNSYTSFGGSFRRRPRMSSQRTNTTGRLRSSMGSMGSLRSLNGTPRVRANNRSRRGVDFSSIRARDRLQARVRENVRAAPSSAAGSSVVDRRNSCRQQQRQKAAIIHSADNTLKSRDETLIWDEELQQLGYRIAMDCDEAFRSSLVGSETSVAVSGSRENSPFSLSLGASSPSPQPESPTALPLQQQAVNHSWVNRPLPPIPSIEISPVVNQTYGVNVVRPAPLRIERLSLGNCASASQTLVPDRRIVSEPVYTTPANRDPRQLPSINETASEDWTRNASTRWASPDTPSPAENNKALNYLARAENTIRVVNSPTAGPVPMPEPLNVRKVSKATPAASGESNYRKTALSNIPPDFKENCPPGTQQEEQGVGDNTVNAGAPAKKRVPSWFRRSSKDNTSFATTANTAAIHNDSTIISDIHQQLDGLESQSSARPDPYPNKKKAFSLAFWKGSKSENSSPTASTFDISTSKEGGGKKHKSSKSESRVVSGATSQSWGEGEGVGRQIEVQQNWLARLFRVKPATRHLCFSMPRRRARQEVAILLREWRQFGIKDVEVDKERNIIFARVGAQNVHNVKEVSFAIEIMMVIEHGKRNQRTQLSIARFTQEKGAASSFHKVVDAINVEFRNRGLLVTDKRKTQMMIKTLNS

SEQ ID NO: 9494 - protein, 637 aa, Cucumis melo
MMESCDCIDAQWPPDELLVKYQYISDVLIALAYFSIPLELIYFVQKSAFFPYRWVLMQFGAFIVLCGATHFINLWTFSMHSKAVAVVMTVAKVACAIVSCATALMLVHIIPDLLSVKTRELILKNKAEQLDREMGLILTQEETGRHVRMLTHEIRSTLDRDTILKTTLVELGKTLGLEECALWMPSRNGLSLQLSHALNYQIPVGTNIPINLPVVNDVFNSNRAICVPYTCQLARVRTPVGGRYLPPEVVAVRVPLLNLSNFQMNNWPDGSSRSYAIMVLILPTDSARKWRDHELELVDVVADQVAVALSHAAILEESMRARDQLVDQNVALDLARREAETAIHARNDFLAVMNHEMRTPMHAIIALSSLLLETELTPEQRVMIETILKSSNLLATLINDVLDLSRLEDGSLVLDMGSFNLHAIFKEALDLIKPIASVKKLSMALILASDLPICAVGDEKRLMQIILNIVGNGVKFTKEGHVSIIASIAKLDSLRDWRPTEFYPMQSDGQFYLRVQVKDSGCGIPPQDIPHLFTRFTQLQTRSNKTNSGVGLGLALCKRFINLMGGHIWIESEGPDKGTTAMFIVKLGICNANPNDLSVKQVAPIVNHRSADLHGQRPIFRETGQVAFSNSRYQRSL

SEQ ID NO: 9495 - protein, 363 aa, Simicratea welwitschii
QSQKLAVRAISQLQSLPGGDIKLLCDTAVESVRDLTGYDRVMVYRFHEDEHGEVVAESKRPDLEPYIGLHYPATDIPQASRFLFKQNRVRIIVDCHASPVSVIQDDGLMQPLCLVGSTLRAPHGCHAQYMENMGSIASLAMAVIINGNDEEGMGGRNPTRLWGLVVCHHTSSRCIPFPLRYACEFLMQAFGLQLNMELQLAAQLLEKHVLKTQTLLCDMLLRESPTGIVTQSPSIMDLVKCDGAALYYQANYYPLGVTPTEAQIRDIVEWLLACHGDSTGLSTDSLADAGYPGATLLGDAVCGMAVAYITNRDFLFWFRSHTAKEIKWGGAKHHPEDKDDGQRMHPRSSFKAFLEVVKSRSLP

SEQ ID NO: 9496 - protein, 476 aa, Arabidopsis thaliana
  misc_feature (103)..(103): Xaa can be any naturally occurring amino acid
  misc_feature (120)..(120): Xaa can be any naturally occurring amino acid
  misc_feature (186)..(186): Xaa can be any naturally occurring amino acid
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTXGTHHAVLSSYEYVSQGXLRQYNLDNMMDGFYIAPAFMDKLVVHITKNFLTLPNIKVPLILGSRGGKGQGKSFQCELVMAKMGXINPIMMSAGELESGNAGEVRKLIRQRYREAADLIKKGKMCCLFINDLDAGAGRMGGTTQYTVNNQMVNATLMNIADNPTNVQLPGMYNKEENARVPIICTGNDFSTLYGPLILDGRMEKFLTGPTREDRIGVWGIFRTDKIKDEDIVTLVDQFPGQSIDFFGALRARVYDDEVRKFVESLGVEKIGKRLVNSREGPPVFEQPEMTYEKLMEYGNMLVMEQENVKRVQLAETYLSQAALGDANADAIGRGTFYGKGAHEVNLPVPEGCTDPVAENFDPTARSDDGTCVYNF

SEQ ID NO: 9497 - protein, 133 aa, Zea mays
HASGIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 9498 - protein, 135 aa, Zea mays
MRVHRIVSLLAALLVLLALAAVSSTRSAQEESVADNAGMLAGGIKDVPANENDLQLQELARFAVNEHNKKANALLGFEKLVKAKTQVVAGTMYYLTIEAKDGEVKKLYEAKVWEKPWENFKQLQEFKPVEEGASA

SEQ ID NO: 9499 - protein, 628 aa, Rumex palustris
MNTCDCVDTQWFADDLLIKSQYISDLFIVLAYFSIPLELIYFVQKSALFPYRWVLIQFGAFIVLCGTTHLINLFTFSMHSKTLAVVMAIAKMSTAAVSCITALMLVHIIPDLLSVKMRESILRRRADELDREMGLILSQEETGRHVRMLTHEIRSTLDRHTILKTTLVELGRTLGLEECSLWMPSQTGMTLKLSHALQNLTPVGSCVSLNLPVITEIFNNPGVVRISHTCPLVSTRPISGRYLAPEVAAIRVPLLNLSNFQINDWPDVSGRTYAVMVLVLPCDGLRKFRKHELELIEVVADQVAVALSHAAILEESMRAHDQLLEKNVALDLARQEAELAIRARNDFLAVMNHEMRSAMHAIITLSSFLLETELTPEQRVMIEIILRSSNILATLINDVLDLSRLEDGSLELDSLTFNLHAVFKKVINLLKPITCVKKLSLTLAVAPEAICVVGDEKRLVQTILNVVGNAVKFTKVGKISIIVSVAKPDSLSSWQPADVIYAAVSKGQFYLRVQVKDTGCGINPQEIPHIFDKFYQSQNCRRNSTDSGLGLAICKRFVNLMGGQIWVESEGLDKGSLVTFVVKMGICRNPDERSINQAASTGHMNQSSTDLLGDSSMSFSLKRFEKSC

SEQ ID NO: 9500 - protein, 364 aa, Unknown
  Burkholderia sp. 383
MERSSSSSSPQREPGRGWWRWAAIGGAVAGVAVAFGYVGGWLAPARLTPHRIVDALQTAGGGIHPGFRRNHAKGVCVTGYFEGNGAASMYSVAPFFKAVRTPVVGRFALPGGNPYAPDSSVPIRSLALRLTAPDGEQWRTGMNAMPVFPVATPQAFYAQLMATRPDPKTGKPDPAKVKAFFGSHPETAAFLQWIKGAKPSASYVTESYYGLNAFYFVDAAGKRQAVRWRVVPEQSAGAGDVATAADPNVLQQDVTQRIAAGPQKWKLLVTLAEPGDPVDDATKVWPAQRTTIDAGTLVLDRVEAQDSGPCRDVNYDPTVLPQGIQVSGDPLLPARSAAYADSYLRRTSEEAGVAGVARLSGEGR

SEQ ID NO: 9501 - protein, 365 aa, Salmonella enterica
MSSAKLFTPLKVGAITATNRVFMAPLTRLRSIEPGDIPTPLMAEYYRQRASAGLIISEATQISAQAKGYAGAPGLHSDEQIAAWKKITQGVHTQGGHMAVQLWHTGRISHASLQPGGQAPVAPSAINAGTRTSLRDENGQAIRVETSTPRALDTHEIPGIVNDFRQAIANAREAGFDLVELHSAHGYLLHQFLSPSSNHRTDQYGGSVENRARLVLEVVDAGIKEWGADRIGIRLSPVGTFQNVDNGPNEEADALYLIEALGKRGIAYLHMSEPDWAGGEPYSDAFREKVRARFHGPIIGAGAYTPEKAEDLIEKGLIDAVAFGRDYIANPDLVARLQRKAELNPQRPESFYGGGAEGYTDYPTL

SEQ ID NO: 9502 - protein, 171 aa, Medicago sativa
MKIHHISCLEDNYSYLIVDETTKEAAAVDPVEPEKVLEASNSLGLTIKFVLTTHHHWDHAGGNEKIKQLVPGIKVYGGSIDNVKGCTDALENGDKVHLGADINILALHTPCHTKGHISYYVTGKEDEDPAVFTGDTLFIAGCGKFFEGTAEQMYQSLSVTLGSLPKPTRVY

SEQ ID NO: 9503 - protein, 517 aa, Oryza sativa
  misc_feature (433)..(433): Xaa can be any naturally occurring amino acid
MAMAAMDARKKKSGGGGGEPLLGKYELGRMLGRGTFAKVYLARAVAGGEAVAVKVIDKAEVMGTAGMAPRVLREVAAMRRLRHPHVLRLHEVLATRARIYLVMELATGGDLLSRLAALPRRRLPESAARRVFVQLVDALSYCHARGVAHRDVKPQNVLLDGDGNLKVSDFGLAALPDTLRDDGRLHTACGTPAYAAPEVLRRRAYDGAKADAWSCGVILFVLLAGHLPFDDSNIADMCRKAHRREYELPRWVSQPARRLVSRLLDPNPDTRVAVESLAAHHPWFKRSLSVDSQLDGLLNGEPERAVAFQAAPPPPLNAFDIISMSPGLDLSGLFGEHDKSLREKRFTTTASPEKTLEQFGLAGGKLGYVVVVGKKGVECLPLAGGRLSSGIAAMSVEMSEVAPPLLLVELRLEVAAGDVDGGDGEVKGFGWDXLRMELGDSPLLLVDLRLEVTVDVDGNGGEVQGFGWEQLRMELGDNCLRCCCRSRHLLAHQLRIQLLSAAYHLRQQWRRQLQTWR

SEQ ID NO: 9504 - protein, 402 aa, Shewanella oneidensis
MKHLLRNIASLGLGLSLGLSISLSSQENTKSYRSDFDYPLLQDVLETVETYYVKTVTKDELVQAAIKGIFEHLDPYSSFLNHQELLDLKDSNRGEYFGFGFEVASEKDHISIIAPFANSPAEQAGIQAGDIIIKLNNTPTTETNLADILNQIKQHSLSHQSIRLTLKHRNDEAEFEVMLKPSTITIQSVASKLLDGNIGYVRLSSFQEDSTEDMVRTLSQWQGTQLTGLILDLRNNPGGLLDQAINIADLFLAKGRIVSTSGRFFDANSDYYASPQTMLANVPMLVLINKGSASASEVLAAALQENGRAKLLGETSFGKGTVQSLIPILNNGNAVKLTIAQYNTPKGENIHDIGIKPDIKVVSETGSNQKNMPIIDAISARTDVSQDTIVTSAITWMQHHDE

SEQ ID NO: 9505 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 9506 - protein, 482 aa, Corynebacterium glutamicum
MNANARVFILNSLAMNDPQRSPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDKGIEVHSHPGFLLTEPWEVSTATGTPYKVFTPFSKAAWEVARVHAYETVKNNVPVPSHLTGPEDVELPILEMEQPFWSTTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 9507 - protein, 151 aa, Picea abies
MAMDPLLSTVQQLLGVPDDLERILHAPTRSYMRDTEATASTPVDVKEYPNSYVFIVDMPGLKSNDIKVQVEDENVLNISGERKRNEKEEGEVKYIRMERRVAKFMRKFSLPADCNLEAISAACQDGVLTVTVPKLPPPEPKKPKTIAVKIG

SEQ ID NO: 9508 - protein, 587 aa, Triticum aestivum
  misc_feature (303)..(303): Xaa can be any naturally occurring amino acid
  misc_feature (339)..(339): Xaa can be any naturally occurring amino acid
  misc_feature (362)..(362): Xaa can be any naturally occurring amino acid
  misc_feature (404)..(404): Xaa can be any naturally occurring amino acid
  misc_feature (409)..(409): Xaa can be any naturally occurring amino acid
  misc_feature (417)..(417): Xaa can be any naturally occurring amino acid
  misc_feature (436)..(436): Xaa can be any naturally occurring amino acid
  misc_feature (463)..(463): Xaa can be any naturally occurring amino acid
  misc_feature (473)..(473): Xaa can be any naturally occurring amino acid
MCGILAVLGVGDVSLAKRSRIIELSRRLRHRGPDWSGIHSFEDCYLAHQRLAIVDPTSGDQPLYNEDKTVVVTVNGEIYNHEELKAKLKSHQFQTGSDCEVIAHLYEEYGEEFVDMLDGMFSFVLLDTRDKSFIAARDAIGICPLYMGWGLDGSVWFSSEMKALSDDCERFISFPPGHLYSSKTGGLRRWYNPPWFSESIPSAPYDPLLIRESFEKAVIKRLMTDVPFGVLLSGGLDSSLVASVVSRYLAETKVARQWGNKLHTFCIGLKGSPDLKAAKEVADYLGTVHHEIHFTVQEGIDAXEEVLYHIQTYDVTTIRASPPIVSNVSGKINSWGVKXMVFSGEGSDEIFGGYLYFHKAPXQKELHEETCRKDKALPLYDCLRANKSTSAWGLEACVPFLDKXFIHVXMGLDPECXMIGVILVDRKWVRVCIYNXKSPFFQAIFKAKRNSSPNGVGYSWIMXGHANALVSNXMTNASFVYPENTPTTKEAYYYRTVFEKFYPKNAARLTVPGGPSVACSTAKAVEWDAAWSKLLDPSGRAALGVHDAAYEEEKAPASVDPVLENAFHPPAHGESTLVKSAVPAAAV

SEQ ID NO: 9509 - protein, 193 aa, Triticum aestivum
HSITSLYKKAGWYRSGIPGISSTHASGVCVLSGAGTVTNLTLRQPASQGAVVALHGRFEILSLSGSFLPPPAPPEATGLTVYLAGGKGQVVGGTVVGSLTAAGPVVIMAASFANAVYERLPLEEDELLAAQGQADSAGMLAAGQQASQMAGGDVDPSLFEGLPPNLLGNVQLPPEAASYRWNPGTAGGRPSPF

SEQ ID NO: 9510 - protein, 355 aa, Brassica napus
MAAQGNSTDTLFSPYKMGRFDLSHRVVLAPMTRCRALNGVPNAALAEYYAQRTTPGGFLISEGTMISPGSAGFPHVPGIYSEEQVEAWKHVVEAVHSKGGLIFCQLWHVGRASHPLYQPNGGSPISSTDKPISERWRVLLPDGSHAKYPKPRPLHASEIPRVVEDYCNSAVNAIRAGFDGIEIHGAHGYLIDQFMKNGINDRTDQYGGSIENRCRFLLQVVKGVVSAIGASKVGVRISPAIDHLDATDSDPLSLGLAVVDLLNKLQDDTGSKLAYLHVTQPRYHAYGQTESGRQGSDEEEAKLMKSLRTAYNGTFMSSGGFNKELGMQAIRQGDADLVSFGRLFIANPDLVSRFK

SEQ ID NO: 9511 - protein, 363 aa, Simicratea welwitschii
QSQKLAVRAISQLQSLPGGDIKLLCDTAVESVRDLTGYDRVMVYRFHEDEHGEVVAESKRPDLEPYIGLHYPATDIPQASRFLFKQNRVRIIVDCHASPVSVIQDDGLMQPLCLVGSTLRAPHGCHAQYMENMGSIASLAMAVIINGNDEEGMGGRNPTRLWGLVVCHHTSSRCIPFPLRYACEFLMQAFGLQLNMELQLAAQLLEKHVLKTQTLLCDMLLRESPTGIVTQRPSIMDLVKCDGAALYYQANYYPLGVTPTEAQIRDIVEWVLACHGDSTGLSTDSLADAGYPGATLLGDAVCGMAVAYITNRDFLFWFRSHTAKEIKWGGAKHHPEDKDDGQRMHPRSSFKAFLEVVKSRSLP

SEQ ID NO: 9512 - protein, 479 aa, Bacillus halodurans
MVVVIAAIVGAVAYLSNFGLAGDNVSSPQEETASSESSPPATLSDEEAFAKFQQAFQLIQDRYVDEVDEEKLLQGAIEGMLGTLDDPYSVYMDPETAAEFVQSLDSHFEGIGAEVSMTNGYVTIVAPFRESPAEKAGLQPNDRILEIDGESTEGLSLYEAVLKIRGEKGTTVDLTIERPGASNVVNITVERDEIPIETVHVHRFERNGLTIGMLEITSFSEDTADRFEEGLAQLEGEGIDGLIIDVRGNPGGYLNAVEDIGSLIIPEGEPIVQIQNRDGEKMRYLSTLKEEKPYPIVGLTDRGSASASEILAAALKEAGHYDVVGETTFGKGTVQQSIELGDGSEIKLSLFRWLTSDGNDINGVGVEPTVEVLQPDYFYTAPLSVEEPLELDMLNDQIEHAQMMLKGLGFEPGRTDGYFEEQTEKAVRAFQDSQELETTGVLDEETAIALQQSIVDLVRDQENDQQLRVALDLIVEQAQ

SEQ ID NO: 9513 - protein, 85 aa, Unknown
  Malus x domestica
NFDLVGNNFPVFFIRDGIKFPDMVHALKPNPKSHIQEFWRILDFFSHHPESLHMFTFLFDDIGVPQDYRHMDGSGVNTYTLIDKA

SEQ ID NO: 9514 - protein, 173 aa, Unknown
  Bradyrhizobium sp. BTAi1
MAEPTKLPVNTDKATAPSVQGWRPFESLRREIDRVFEDFHSGIWRTPSLFDQLPSLPRTRSFAVAPAVDVAEHDNAYEVSAELPGLDEKNVEVKVTNGVLSIRGEKQEDKEEKKKDYYVRERSFGSFERSFQIPDGVDTDKIEAVFRQGVLKVTLPKKPEVQKAAKTIDIKAA

SEQ ID NO: 9515 - protein, 381 aa, Unknown
  Parachlamydia sp. UWE25
MKIKEFNWGPTLFLTIYQTLLLLSLPFYFYFTPPSLGMIGISIILLYLTGLSITAGYHRFYSHRSYRTNSFVEMLLLFFGSMAGQGSALRWSFDHRLHHAHVDTDCDPYSIKKGFWYAHCLWILEKPKKIEAKVVPDLIKNRLVQFQHKYDFLCMLISNGIAFLVVGWFLDDYMGAFFLACWTRLFLLHHFTWFINSLAHTWGDRPFCQEQSAVNNYILALLTFGEGYHNYHHTFCNDYRNGIRWFHFDPTKWLIWTLSKCGLTKELKRMDSYTIQKRMVLERKRLLLGRVCNLWYVKKDELEKLVRELAEKLVVEFAEFNQLRVNYRLARKEGREPDQLKVFKQKLSILKKNLKSNWRLWKQLSRHILKLKPFESFPCPI

SEQ ID NO: 9516 - protein, 245 aa, Siphonodon australis
ALSIAGAVQSQKLAVRAISQLQSLAGGDIKLLCDTVVESVRDLIGYDRVMVYKFHEDEHGEVLAESKRPDLEPYIGLHYPATDIPQASRFLFKQNRVRMIVDCHASPVRVIQDDGLMQPLCLVGSTLRAPHGCHAQYMENMGSTASLVMAAMINGNDEKATGGRNTTKLWGLVVCHHTSARCIPFPLRYACEFLMQAFGLQLNMELQLAAQLSEKHVLKTQTLLCDMLLRDSPTGIVTQSPSIMD

SEQ ID NO: 9517 - protein, 556 aa, Arabidopsis thaliana
MQRFCVCSPSSYRLNPITSMATGSGSLIWFRKGLRVHDNPALEYASKGSEFMYPVFVIDPHYMESDPSAFSPGSSRAGVNRIRFLLESLKDLDSSLKKLGSRLLVFKGEPGEVLVRCLQEWKVKRLCFEYDTDPYYQALDVKVKDYASSTGVEVFSPVSHTLFNPAHIIEKNGGKPPLSYQSFLKVAGEPSCAKSELVMSYSSLPPIGDIGNLGISEVPSLEELGYKDDEQADWTPFRGGESEALKRLTKSISDKAWVANFEKPKGDPSAFLKPATTVMSPYLKFGCLSSRYFYQCLQNIYKDVKKHTSPPVSLLGQLLWREFFYTTAFGTPNFDKMKGNRICKQIPWNEDHAMLAAWRDGKTGYPWIDAIMVQLLKWGWMHHLARHCVACFLTRGDLFIHWEQGRDVFERLLIDSDWAINNGNWMWLSCSSFFYQFNRIYSPISFGKKYDPDGKYIRHFLPVLKDMPKQYIYEPWTAPLSVQTKANCIVGKDYPKPMVLHDSASKECKRKMGEAYALNKKMDGKVDEENLRDLRRKLQKDEHEESKIRNQRPKLK

SEQ ID NO: 9518 - protein, 374 aa, Siphonodon celastrineus
ALSIAGAVQSQKLAVRAISQLQSLAGGDIKLLCDTVVESVRDLTGHDRVMVYKFHEDEHGEVLAESKRPDMEPYIGLHYPATDIPQASRFLFKQNRVRMIVDCHASPVRVIQDDGLMRPLCLVGSTLRAPHGCHAQYMENMGSTTSLVMAAYINGNDEKATGGRNATKLWGLAVCHHTSARCIPFPLRYACEFLMQAFGLQLNMELQLAAQLSEKHVLKTQTLLCDMLLRDSPTGIVTQSPSIMDLVRCDGAALYYQGNYYPLGVTPTEAQIKDIVEWLLAVHGDSMGLSTDCLADAGYPGSALLGDAVCGMAVAHITNRDFLLWFRSHTAEEIKWGGAKHRPKDKDDGQRMHPRSSFKAFLEVVKSRSLPWEN

SEQ ID NO: 9519 - protein, 154 aa, Coursetia madrensis
RVMAYKFHEDDHGEVIAEITKPGLEPYLGLHYPATDIPQAARFLFLKNKVRMIVDCHAKHVKVLQDEKLPIDLSLCGSTLRAPHSCHLQYMANMDSIASLVMAVVVNDSDEDGDSSDAVQPQKRKRLWGLVVCHNTTPRFVPFPLRYACEFLAQ

SEQ ID NO: 9520 - protein, 475 aa, Zea mays
  misc_feature (248)..(248): Xaa can be any naturally occurring amino acid
  misc_feature (254)..(254): Xaa can be any naturally occurring amino acid
  misc_feature (310)..(310): Xaa can be any naturally occurring amino acid
MGKRSGGRKLPFFTRSSSSSSKRNRSGRRLPSPSKQDNATRALLASPTAASPSATPDSAAAGQTAQPPSPLSVTAGAGGALSGKITKKKPGARLWMRLDRWGASEVVELDKATIIRRAGLPSRDLRILGPVFSRSSSILAREKTMVINLEFIRAIVTAEEVLLLDPLMHEVLPFVDQLRQHLPLRSLVGGNGECAPDGNGEKQGGSHGGQVPRLNEATGAEHEFPFEFHVLEVALEIVCSSLDLAVMXERHATXVLDELTKNVSTRNLERVRSLKSHLTRLLARVQKVRDEIEHLLDDNEDMEHLYLTRXQVHNQQDEAVMSSADSNSIGLAGPGVPRLNSSVRRSLSVATSMHLHNDVEDLKMLLEAYFMHLDGIRNRILSVRQYIDDTEDYFNIQLDNQRNELIQLQLTLTIASFGIAANTFIVGAFAMNIPSSLYNTDNTLFWPFVGGTSSGCFVITILLFGYAWWKKLLGP

SEQ ID NO: 9521 - protein, 374 aa, Siphonodon celastrineus
ALSIAGAVQSQKLAVRAISQLQSLAGGDIKLLCDTVVESVRDLTGHDRVMVYKFHEDEHGEVLAESKRPDMEPYIGLHYPATDIPQASRFLFKQNRVRMIVDCHASPVRVIQDDGLMRPLCLVGSTLRAPHGCHAQYMENMGSTASLVMAAYINGNDKKATGGRNATKLWGLAVCHHTSARCIPFPFRYACEFLMQAFGLQLNMELQLAAQLSEKHVLKTQTLLCDMLLRDSPTGIVTQSPSIMDLVRCDGAALYYQGNYYPLGVTPTEAQIKDIVEWLLAVHGDSMGLSTDCLADAGYPGSALLGDAVCGMAVAHITNRDFLLWFRSHTAEEIKWGGAKHRPKDKDDGQRMHPRSSFKAFLEVVKSRSLPWEN

SEQ ID NO: 9522 - protein, 323 aa, Arabidopsis thaliana
  misc_feature (236)..(236): Xaa can be any naturally occurring amino acid
  misc_feature (280)..(280): Xaa can be any naturally occurring amino acid
  misc_feature (286)..(286): Xaa can be any naturally occurring amino acid
  misc_feature (293)..(293): Xaa can be any naturally occurring amino acid
MVMIEGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWXKLFIQTMDPADEGKFDFDPLDVTKIWPEDILPLQPVGRLVLNRXIDNFFXMKTEQLXFNPGLVGSLGILLPQDGKACSNCRVLFAYW

SEQ ID NO: 9523 - protein, 357 aa, Unknown
  Burkholderia sp. 383
MSQLFTPVRVGRYTLENRLVMAPMTRSRAAFDGTPGEWAAEYYAQRSSLGLIVSEGTQPSDDGQGYLTTPGIYTDAHVAGWKAISDRVHARGGRLFIQLMHVGRMSHPDNTPHHRQAVAPSAIAPNAPMFTMKGMLDIPAPRALTLDEVRETVNDFRIAARRAIEAGADGVEIHGANGYLIQQFFAPNANTRTDAYGGSIDNRARFAIEVATAIADEIGADRTALRVSPGNTLGGLDEGTEGPDLYRHLATELDRLGLAYLHVMHQGDEALLADLRSRWNGTLILNRPGRARDAIGDDLKSGLADLEAYGQMVLANPDFVTRVKTGAPMNDARRETFFGGDARGYVDYPALGGVAAA

SEQ ID NO: 9524 - protein, 646 aa, Unknown
  Mesorhizobium sp. BNC1
MCGFGGYFGAGVSEAEPLLRRMASAIAHRGPDERGTAVLDGAGLCHTRLSIVGLADGQQPMSLDGGRLTIAFNGEIFNYVELREALIARGRTFRTASDTEVILHLYDEKGPDCLADLNGDFAFAIWDAPRRRMFLARDRMGVRPLFYTSVGDRLFFASEVKTLLQVPGVEAEMDPFALDQMFTLWAPIAPRTAFKNIHELEPGHMMLVEEGRQAIRPYWSLSFPEHGAPSRHTDERAVAEELRALLTDATRLRMRADVPVGSYLSGGLDSSVISALAAGMTPEILRTFSVAFESAEHDESAFQNEVAAALGTMHASVNCGDGDIAAVFPDVIRFTERPILRTAPAPLFKLSALVRERGLKVVLTGEGADEVFAGYDIFKEARVRRFCARQPGSRMRPHLFRKLYPYLPGLKQQSAEYLAAFFGAGADSLDDPLFSHKPRMRATGAAKLFFSAQLRETLAGYDAAEELASRLPQEFPRWHPLHQAQYLESRFLLPGYILSSQGDRMAMAHGIEGRFPFLDHRLVEFATTLPPEMKLKGLVEKHILREATKGLLPESILRRTKQPYRAPDSASFRGAGEKDYVREAMSAEKLADCGLFNPASVSKLFAKSRQQPLSGFRDNAAFVGILSSQLWLETFTGSRIRAVEAA

SEQ ID NO: 9525 - protein, 461 aa, Hordeum vulgare
MVHQSNGHGEAAAAAANGKSNGHAAAANGKSNGHAAAAAVEWNFARGKDGILATTGAKNSIRAIRYKISASVEESGPRPVLPLAHGDPSVFPAFRTAVEAEDAVAAALRTGQFNCYAAGVGLPAARSAVAEHLSQGVPYKLSADDVFLTAGGTQAIEVIIPVLAQTAGANILLPRPGYPNYEARAAFNKLEVRHFDLIPDKGWEIDIDSLESIADKNTTAMVIINPNNPCGSVYSYDHLAKVAEVARKLGILVIADEVYGKLVLGSAPFIPMGVFGHIAPVLSIGSLSKSWIVPGWRLGWVAVYDPTKILEKTKISTSITNYLNVSTDPATFVQEALPKILENTKADFFKRIIGLLKESSEICYREIKENKYITCPHKPEGSMFVMVKLNLHLLEEIHDDIDFCCKLAKEESVILCPGSVLGMENWVRITFACVPSSLQDGLERVKSFCQRNKKKNSINGC

SEQ ID NO: 9526 - protein, 188 aa, Arabidopsis thaliana
MTNYGAIPTSSHASPLVDVESLSRAKHRIKAGLATRRAWRVMFDFHSMGLPHGVSDAFTRIKTNLAYFRMNYAIVVLIVIFFSLIWHPTSLIVFTVLVVVWIFLYFLRDEPIKLFRFQIDDRTVLIVLSVLTVVLLLLTNATFNIVGALVTGAVLVLIHAVVRKTEDLFLDEEAATTETSGLTSYPST

SEQ ID NO: 9527 - protein, 363 aa, Pseudomonas putida
MSALFEPYTLKDVTLRNRIAIPPMCQYMAEDGLINDWHQVHYASMARGGAGLLVVEATAVAPEGRITPGCAGIWSDAHAQAFVPVVQAIKAAGSVPGIQIAHAGRKASANRPWEGDDHIGADDARGWETIAPSAIAFGAHLPNVPRAMTLDDIARVKQDFVDAARRARDAGFEWIELHFAHGYLGQSFFSEHSNKRTDAYGGSFDNRSRFLLETLAAVREVWPENLPLTARFGVLEYDGRDEQTLEESIELARRFKAGGLDLLSVSVGFTIPETNIPWGPAFMGPIAERVRREAKLPVTSAWGFGTPQLAEAALQANQLDLVSVGRAHLADPHWAYFAAKELGVEKASWTLPAPYAHWLERYR

SEQ ID NO: 9528 - protein, 565 aa, Candida albicans
MKTTTTTTTTTTTKNGGEWIYRLDPWVHRATFAKQHALYEGHFWEDNYQFKNPRPKKNIAAGGIKIYEAHVGISTPEPTIGSYKNFTQNVLPIIRDLGYNTIQLMAIMEHAYYASFGYQVTSFFAISSRYGTPDELKELIDTAHGMGTQVLLDVVHSHSSKNVDDGLNMFNGTDHYLFHGGSRGNHDLWDSRLFNYTNYETLRFLLSNLKYYIDVFQFDGFRFDGVTSMLYKHHGLSVGFSGGYHEYFGDGVDNEAIVYLMLAHQLMNEISTTQNFNLTSIAEDVSGMPTLCRPISDGGIGFNYRLSMAIPDMWIKILKHLTDEQWDLGNIVHTLTNRRYGEKVIAYCESHDQALVGDKTLAFWLMDKEMYTNMSVLSPLTPIIDRGIALHKLIRLVTFALGGDGYLNFEGNEFGHPEWLDFPRQGNGESYHYARRQFNLINDDLLRYKYLYQFDKKMLQLEITNTGEYVSLKHEGDKVLVFEKGKSVYIFNFNPTQSFVDYRIGVELPGTYKLVLDSDSEDLGGHGRLDHNTKYFTFNEPWNNRSNSLLVYIPTRTAIVLEKVE

SEQ ID NO: 9529 - protein, 496 aa, Zea mays
  misc_feature (451)..(451): Xaa can be any naturally occurring amino acid
  misc_feature (466)..(466): Xaa can be any naturally occurring amino acid
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDHVGVPSDYRHMEGFGVNTYTFVSAAGKAQYVKFHWKPTCGERSILTDEEARVGGRNHSHTQDLYDSIAAEGSFPEWTLYVQVMDPAQQEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVXRRFADSLGHPNVSQXLRSIWIDLLAKVDASLGMKIATRLNMKANM

SEQ ID NO: 9530 - protein, 349 aa, Pseudomonas fluorescens
MATIFDPIKLGDLELSNRIIMAPLTRCRADEGRVPNALMAEYYVQRASAGLILSEATSVTPMGVGYPDTPGIWSNDQVRGWTNITKAVHAAGGKIVLQLWHVGRISHPLYLNGEAPVAPSAIQPKGHVSLVRPLADYPTPRALETAEIAEIVEAYRTGAENAKAAGFDGVEIHGANGYLLDQFLQSSTNQRTDNYGGSLENRARLLLEVTDAAIDVWGAGRVGVHLAPRADSHDMGDDNLAETFTYVARELGKRGIAFICSREKEGADSLGPQLKEAFGGAYIANERFTKDSANAWLAEGKADAVAFGVPFIANPDLPARLKADAPLNEPRPELFYGKGPVGYIDYPTL

SEQ ID NO: 9531 - protein, 686 aa, Emericella nidulans
MTSTAPSDGTGIIDLDPWLEPFREAIKRRFDYVDEVEGGLDKFSKGYEKFGFNESWIKTVVSETGDITYREWAPNAIEAALVGDFNNWDTKANPMTRDNFGVWEIALPAKNGTPVIPHDSKVKVKITMVTRSGERIYRIPAWIKRVVQDLNVSPIYESVFWNPPKAERYNFQHARPKKPESLRIYEAHVGISSPDTRVATYKEFTANMLPRIKYLGYNAIQLMAIMEHAYYASFGYQVNNFFAASSRYGKPEDLKELVDTAHSMGLVVLLDVVHSHASKNVDDGLNMFDGSDHLYFHSGSKGQHELWDSRLFNYGNHEVLRFLLSNLRFWMEEYGFDGFRFDGVTSMLYTHHGIGTGFSGGYHEYFGPAVDDDGVMYLALANEMLHRLYPDCITVAEDVSGMPALCLPHGLGGVGFDYRLAMAIPDMYIKLLKEKSDNDWDIGNLAFTLTNRRHGEKTIAYAESHDQALVGDKSLMMWLCDKEMYTHMSVLTEFTPVIERGMALHKMIRLVTHALGGEGYLNFEGNEFGHPEWLDFPRAGNNNSFWYARRQLNLTEDHLLRYRFLNEFDRAMQLTESKYGWLHAPQAYISLKHEGDKVLVFERADLLWIFNFHPTESFTDYRVGVEQAGTYRVVLDTDDQAFGGLGRIDQGTRFFTTDMEWNGRRNYLQVYIPTRTALALALEETL

SEQ ID NO: 9532 - protein, 482 aa, Lactobacillus gasseri
MTGYTMPKGFLWGGAVAAHQLEGAWNEDGKGMSVADVMTVGSATKPREITDGVIPGKNYPNHDAIDFYHHYKGDIKLMAEMGFKAFRTSIAWTRIFPKGDEKEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYGLVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLQRSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGEGTLERSKKDSFDWYKKVIESNGKDLD

SEQ ID NO: 9533 - protein, 157 aa, Triticum aestivum
MSLIRRSNVFDPFSLDFFDPFEGFPFGSGNSSSGSLVPRTSSDTAAFAGARIDWKETSEAHVFKADVPGLKKEEVKVEVEDGNILQISGERKKEQEEKTDTWHRVERSSGKFLRRFCLPDNAKAEQVKASMENGVLTVTVPKEEAKKPEVKSIQISG

SEQ ID NO: 9534 - protein, 513 aa, Pseudomonas aeruginosa
MNPSLNAFRPGRLLVAASLTASLLSLSVQAATLTRDNGAPVGDNQNSQTAGPNGSVLLQDVQLLQKLQRFDRERIPERVVHARGTGAHGEFVASADISDLSMAKVFRKGEKTPVFVRFSAVVHGNHSPETLRDPRGFATKFYTADGNWDLVGNNFPTFFIRDAIKFPDMVHAFKPDPRSNLDDDSRRFDFFSHVPEATRTLTLLYSNEGTPASYREMDGNSVHAYKLVNARGEVHYVKFHWKSLQGQKNLDPKQVAEVQGRDYSHMTNDLVSAIRKGDFPKWDLYIQVLKPEDLAKFDFDPLDATKIWPGIPERKIGQMVLNRNVDNFFQETEQVAMAPSNLVPGIEPSEDRLLQGRLFAYADTQMYRVGANGLGLPVNRPRSEVNTVNQDGALNAGHSTSGVNYQPSRLDPREEQASARYVRTPLSGTTQQAKIQREQNFKQTGELFRSYGKKDQADLIASLGGALAITDDESKYIMLSYFYKADSDYGTGLAKVAGADLQRVRQLAAKLQD

SEQ ID NO: 9535 - protein, 490 aa, Zea mays
  misc_feature (204)..(204): Xaa can be any naturally occurring amino acid
MVLSHAASAGSSDESVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDEXNTICVAAILGSTLTGEFEDVRRLNDLLAANNRRTGWDTPIHVDAASGGFIAPFLYPDLEWDFRLPLVKSINVSGHKYGLVYAGVGWVVWRSKEDLPDELIFHINYLGADQPTFTLNFSKGSSQIIAQYYQLIRLGFEGYKDVMQNCRDNAAVLREGINKMGYFDVVSKDSGVPLVAFSLKDSSKYTVFEVAESLRRFGWIVPAYTMPADAEHVAVMRVVIREDFSRGLAERLIADLGKTMADMDAHAGRKQAPEQPKKSVHDIEKEVTTFWRRLVANSKKKSSMVC

SEQ ID NO: 9536 - protein, 174 aa, Brassica napus
  misc_feature (92)..(92): Xaa can be any naturally occurring amino acid
MANQVISGIKETVQSINGAARPWGDFLDLSAFSFPSSFSDATTRLTQNLAHFRINYTIILSVLLALTLITRPIAILAFVAVGLAWFFLYFAXREEALTGFGFTVDDGVVAVLLIVLTIAALVTTGVWLSALTTVGFGALVLILHAALRGTEDLVTDDLESPYGPMLSTGGGRYG

SEQ ID NO: 9537 - protein, 533 aa, Rubrivivax gelatinosus
MVEGVNILANAVKVTLGPKGRNVVLERSFGAPTVTKDGVSVAKEIELKDKLQNMGAQMVKEVASKTSDNAGDGTTTATVLAQAIVREGMKYVAAGMNPMDLKRGIDKAVVSLVEQLKKQSKPTTTSKEIAQVGTISANSDDDVGQIIASAMDKVGKEGVITVEDGKSLNNELDVVEGMQFDRGYLSPYFINNPEKQSAVLDNPFVLLYDKKISNIRDLLPTLEQVAKSGRPLLIIAEEVEGEALATLVVNTIRGILKVVAVKAPGFGDRRKAMLEDIAILTGGKVIAEEVGLTLEKVTLADLGQAKRVEVGKENTTIIDGAGAAGDIEARVKQVRVQIEEATSDYDREKLQERVAKLAGGVAVIKVGAATEVEMKEKKARVEDALHATRAAVEEGIVAGGGVALLRAKQAAGAIKGDNADQDAGIKLILRAIEEPLRIIVTNAGDEASVVVNAVLAGKGNYGYNAANGTYGDMIEMGILDPTKVTRTALQNAASVAALMLTTEAMVAESPKDDAPAGGMPGGMGGMGGMGMDM

SEQ ID NO: 9538 - protein, 475 aa, Streptomyces coelicolor
MSLHQGPRPSRDSDRDRRRLAVNPFHAAANPLGGMTEAPPAHRLPDSPLPPESAYRLVHDELMLDGNARLNLATFVTTWMEPQAGVLMSECRDKNMIDKDEYPRTAELERRCVAMLADLWHAPDPSTAVGCSTTGSSEACMLAGMALKRRWALRNADRYPAKDVRPNLVMGVNVQVCWDKFCNFWEVEARQVPMEGDRFHLDPQAAAELCDENTIGVVGILGSTFDGSYEPVADLCAALDALQERTGLDVPVHVDGASGAMVAPFLDEDLVWDFRLPRVASINTSGHKYGLVYPGVGWALWRDAEALPEELVFRVNYLGGDMPTFALNFSRPGAQVVAQYYNFLRLGREGYRAVQQSARDIAGSLAERVAALGDFRLLTRGDQLPVFAFTTADDVTAYDVFDVSRRLREGGWLVPAYTFPPHREDLSVLRVVCRNGFSADMADLLLADLERLLPELRRQPGPLTRDKGAATGFHH

SEQ ID NO: 9539 - protein, 536 aa, Nocardia farcinica
MAKQIEFDEKARRALERGVDKLADAVKVTLGPRGRHVVLAKAFGGPTVTNDGVTIARDIDLEDPFENLGAQLVKSVATKTNDVAGDGTTTATVLAQALVRGGLKNVAAGANPIAVGSGIAKAADAVSEALLAAATPVSGEQAIAQVATVSSRDEEIGEMVGKALTTVGKDGVVTVEESSTLQTELVVTEGVQFDKGYLSPYFITDTDTQEAVLEDAFVLLHREKISSLPDLLPLLEKIAEAGKPVLIVAEDVEGEALSTLVVNSIRKTLKAVAVKAPFFGDRRKAFLDDLAVVTAGTVVNPDLGITLREAGIDVLGKARRVVVTKDETTIIDGAGTAEDIAARAAQLRREIEATDSDWDREKLEERLAKLAGGVAVIKVGAATETALKERKYRVEDAVSAAKAAVDEGIVPGGGTALVQAATKLVELRDSLSGDEAVGVEVVRKALEAPLFWIASNAGLDGAVVVSKVAEGKEGFNAATLSYGDLLTDGVVDPVKVTRSAVVNAASVARMVLTTESAVVDKPAEEAEDHSHHGHAH

SEQ ID NO: 9540 - protein, 468 aa, Streptococcus suis
MVKTLPKDFIFGGATAAYQAEGATQTDGKGRVAWDKYLEDNYWYTAEPASDFYNRYPVDLELSEQFGVNGIRISIAWSRIFPTGFGAVNPKGVEYYHKLFAECHKRHVEPFVTLHHFDTPETLHSNGDFLNRENIEHFVNYAAFCFKEFPEVNYWTTFNEIGPIGDGQYLVGKFPPGIQYDLAKVFQSHHNMMVSHAKAVKLYKDAGYSGEIGVVHALPTKYPYDPSNPDDVRAAELEDIIHNKFILDATYLGYYSEKTLEGVRHILKVNGGELDLRDEDFAALDAAKDLNDFLGINYYMSDWMRAHDGETEIIHNGKGEKGSSKYQIKGVGRRESPVDIPKTDWDWIIYPQGLYDQIMRVKNDYPNYKKIYITENGLGYKDEFVDGTVYDDGRIDYVKKHLEVISDAISDGANVKGYFIWSLMDVFSWSNGYEKRYGLFYVDFETQERYPKKSAYWYKKVAETQVIE

SEQ ID NO: 9541 - protein, 541 aa, Bifidobacterium breve
MAKIISYDEEARQGMLEGLDKLANTVKVTLGPKGRNVVLDKTYGAPTITNDGVSIAKEIDLEDPYERIGAELVKEVAKKTDDVAGDGTTTATVLAQSLVHEGLKNVVAGSNPIALRRGIEKATEVIVKELVVAAKDVETKDQIAATATISAADPEVGEKIAEALDKVGQDGVVTVEDNNRFGLDLDFTEGMRFDKGYIAPYFVTNADDQTAVLEDPYILLTSGKVSSQQDIVHVAELVMKTGKPLLIIAEDVDGEALPIPDSEQHSWYLQVLRCQGSGLRRPPQGMLQDMAILTGAQVVSDELGLKLESVDTSVLGHAKKVIVSKDETTIFQGAGSKEDIDARVAQIRAEIENTDSDYDREKLQERLAKLAGGVAVIKVGAATEVEAKERKHRIEDAVRNAKAAIEEGLLPGGGVALVQAAAKAEKAEAVTSLTGEEATGAAIVFRAIEAPIKQIAENAGVSGDVVINKVRSLPDGEGFNAATDTYEDLLAAGVTDPVKVTRSALQNAASIAGLFLTTEAVVANKPEPKAAAPAAGADMGY

SEQ ID NO: 9542 - protein, 548 aa, Neorickettsia risticii
MANEVISGEQLQKVIRDAADLVVSSAGVTLGPEGRPVIMSKSYGGPEVTKDGYKVINNLKPEDEKIAKIVELLNQATSQANEKAGDGTTTATILVGNMIKNAHKHIAAQRSRTKLKSGMKRARDEVVKYIQSVAKKINSEEEIAQVGSISANGNSEIGNKIAEAMNKVGKEGVITVEEGKGLDEFSVSVVQGMVFDRGYVSPYFITNPEKMIVEFDNPYVLLANKKLSSIQPMVPLLETIVRSNRAVVIIAEDVEGEALTSLVLSKMRGSLKACAVKAPGFGDRRSEMLEDIRILTGAKTLVSDDLGVTVESLTVEDLGTAKSIIISKDSTTIVDGGGEKTSIDARVKQIKTQIDKTTSDYDKEKLQERLAKLAGGVAVLKVGGATEVEVKERKDRVEDALHATRAAVEEGIVPGGGATLLSAIAVLEKLSSDDDDEQAGINIVKSALKAPISQIVENAGEDASVITYNLLESKDPNRIFDARELKYVDAFKAGIIDPAKVVRVALESAVSVASVLVTTEALIVDLPTKDNGSPSMMPGGGMGGMGGF

SEQ ID NO: 9543 - protein, 145 aa, Thermoanaerobacter tengcongensis
MSLMRRGRDWWDWPFDINIRNLPSIFDINFPSLSGLFSRPRVDIVESETEIVATAELPGVDKKDIEINVYDNILEIKGQTSVDEEKEDKNYYIRERYYGSFARRIELPAEVDPERTTAKFENGILKITMPKLHPSKPKKRRIDIE

SEQ ID NO: 9544 - protein, 635 aa, Pisum sativum
MMESCECIDTPYPPDELLVKYQYISDVLIALAYFSIPVELIYFVQKSAFFPYRWVLMQFGAFIVLCGATHFINLWTFSAHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRSGLNLQLSHTLTYHVQVGSTVPTNLPIVNEVFNSPRATRIPHTCPLARIRPLVGRYVPPEVVAVRVPLLHLSNFQINDWPDLSAKSFAIMVLILPTDSARKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLAALINDVLDLSRLEDGSLELEMGKINLHGVLEEVIELIKPIASVKKLPITLILAPDLPDNAIGDVKRLMQTLLNVVGNAVKYTKEGYVSIRASVAKPESLQDWRPPEFYPASSDGHFYIRVQVKDSGCGILPQDIPHLFTKFTQSQSGAGRSSSGSGLGLAICKRFVNLMGGHIWMESEGPDKGSTATFVVKLGICGNPDSSDHQATTRGQAYSGSGGLARFKHLVNDGDIGFSNRRNQRSF

SEQ ID NO: 9545 - protein, 373 aa, Unknown
  Burkholderia sp. 383
MTTDSFLSPPRAPARPTLFDPIELGRITLRNRIVMAPMTRSRAGAGDAPGPMNATYYAQRASAGLIVTEGTQISPPGKGYPFTPGIYSDAQIAGWKQVTDAVHREGGRIFVQLAHVGRIGHPDLQPDGALPVAPSPIRPDGDAYTPTGPQPYPVPRALETAELPAIVGQYVLATRAAFQAGFDGVEIHAGNGYLLDQFLRDGTNRRTDDYGGTIDNRLRLPLEVARAVSLVSGPDRLGIRISPVTPHFGGIADSDPQALFERFADRLSGLAVYLHVVEGIPQVAPDAAPAFDYDALRHAFAGHYIANNGYTKTRAETALSDGHADLVSFGYPFIANPDFAERLRHDRPLAHADMSMAYGGGEAGYTDYPPFRA

SEQ ID NO: 9546 - protein, 160 aa, Triticum aestivum
MAGMVFGLDDPMMTALQHLLDIPDGEAGGTAGGEKQGPTRAYVRDARAMAATPADVKELPGAYAFVVDMPGLGSGDIQVQVEDERVLVISGERRREEKEDAKYLRMERRMGKLMRKFVLPENADMEKISAACRDGVLTVTVEKLPPPEPKKPKTIQVQVA

SEQ ID NO: 9547 - protein, 478 aa, Gossypium hirsutum
MDSTSKSNAATSSKKDANNGQTLLLGRYEVGKLLGHGTFAKVYHARNVKSGDNVAIKVIDKEKILKSGLIAHIKREISILRRVRHPNIVQLFEVMATKSKIYFVMEYVRGGELFNKVAKGRLKEDVARKYFQQLISAVHFCHARGVYHRDLKPENLLLDENGDLKVSDFGLSAVSDQIRQDGLFHTFCGTPAFVAPEVLARKGYDAAKVDIWSCGVILFVLMAGYLPFQDQNIMAMYKKIYKGEFRCPRWFSPELIRLLTKLLDTNPETRITIPEIMEKRWFKKGFKHIKFYIEDDKLCSVEDDDNDVGSCSDQSSMSESETELETRKRVGTLPRPASLNAFDLISFSPGFNLSGLFEEGEEGSRFVSGAPVSTIISKLEEIAKVVSFTVRKKDCRVSLEGSREGAKGPLSIAAEIFELTPSLVVVEVKKKGGERGEYEDFCNRELKPGLKELMVEESQSSAAASLATSSSYLPSDTE

SEQ ID NO: 9548 - protein, 639 aa, Thiobacillus denitrificans
MCGITGIFDTSGVNAISRDLLQRMNETQHHRGPDEGGLHLEPGLGLGHRRLSIIDLSSGQQPLANEDGSVVVVFNGEIYNFQELVPELEALGHVFRTHSDTEVIVHAWEAWGEACVARFRGMFAFVLWDRNQETLFVVRDRFGVKPLYYAFLDTGEFIFGSELKSLMVHPSLGREVDPLAVEDYFAYGYVPEPRTIFKRVHKLPPGFTLTLKRGAPRALPKQYWDMPFAPVAVKDEAGAMDELVERMKESIRLRMIADVPLGAFLSGGVDSSAVVAMMATQSSTPVNTCSIGFDDPAFNEIEYAQQVADRYHTRHHVETVAADDFSLVGKLAQVYDEPYADSSALPTYRVCELARKHVKVALSGDGGDEHFAGYRRYRWFRYEERMRSIIPLGLRRPLFGTLGLLYPKADWAPKMFRAKTTFEALARDTVEGYFHGVSLLSNAQRAQLFSPAFRRELQGYQAVDVLRRHAAVAPTDDPLSLVQYLDMKTYLVGDILTKVDRASMAHALEVREPLLDHELMGWVSGLPVDLKLRGSEGKYLLKKAMEPYLPHDVLYRKKMGFSVPLAAWFRGPLAATIRTVVLGERLAGTGMFNCEFLREVVEAHQSGRRDFSVILWTVLMFDAFLGQVLGLDDTAREAA

SEQ ID NO: 9549 - protein, 162 aa, Dehalococcoides ethenogenes
MTLERWQPGWSLRPWRPFREILSPGLWSMLANERDWLPATEMLELKDKYLIKAEMPGINEEDIEVSVSDNVLTIKGEKKYTSEVSEENYYFSERSYGSFSRSMTLPNNTSIQNIAATLDNGILEISIPKVSEAKAKKVSVTKAAKTRKANINTKPGNPKTKS

SEQ ID NO: 9550 - protein, 227 aa, Zea mays
MRSPPPPSPLLPPPPPPRPAQAPLTWRRPLPPRRRRIHLPGAGLLRGQRRLRQDPDLPRAPVVVPRHQPSHAEVFRAAAFSRPPSLGEALARTRRNAAYFRANYALAVLAAVAASLLWHPGTLLALVLLRAAWFFLYFARGNQPLRVLGTEFDDGTVLAALCGVTVVALLFTSVGWNVVGSAMVGGALVGAHVVLRTTDDLFLTEQEAAGDGLDPVGPILPTYVRIV

SEQ ID NO: 9551 - protein, 476 aa, Pediococcus pentosaceus
MKDKKFSDGFLWGGAMAANQCEGAYDIDGKGMSIMDIMTVGNSSKRRRATPEIDPQEYYPNHRGIDFYHKYKDDIKLLKEMGLKCFRTSIAWTRIFPKGDEASPNEKGLAFYDELIDTLLANNIKPVITISHYEMPLYLVEKYGGWKNKKLIDFYLNYCRVLFKRYSGKVKYWMTFNEINSTWFVPAISGVKISNDDPKYLQVKCQTMHNLFVASARAVQMGHEINSNNQIGCMVLTTVGYPKTTNPKDALAADDYITRGTLAFTDVHVRGHYPSFVKRMVQKNHLELDITDEELLDIQTGVVDYIGLSYYSSSVVSSEIDKNADSSIGGNFSMGLKNPYLKANEWGWQSDPDGFRLILRWLGQRYEIPLFVVENGYGHEDEVLSGHIIHDDYRIDYLRKHVNALAEAINEDGVDIIGYTPWGCIDLISASTGEMKKRYGMVYVDLDNTGKGTLSRYKKDSFYWYQKVIESNGGEL

SEQ ID NO: 9552 - protein, 738 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSGSGINPQDIPKLFTKFAQTQSLATRNSGGSGLGLAICKRFVNLMEGHIWIESEGPGKGCTAIFIVKLGFAERSNESKLPFLTKVQANHVQTNFPGLKVLVMDDNGSVTKGLLVHLGCDVTTVSSIDEFLHVISQEHKVVFMDVCMPGIDGYELAVRIHEKFTKRHERPVLVALTGNIDKMTKENCMRVGMDGVILKPVSVDKMRSVLSELLEHRVLFEAM

SEQ ID NO: 9553 - protein, 474 aa, Campylobacter lari
MKKLTNDFGNIVADNQNSLTAGSKGPLLMQDYILLEKLAHQNRERIPERAVHAKGSGAYGELKITADISKYTKAKVLQLGESTPLFIRFSTVAGEAGAADAERDVRGFAIKFYTKEGNWDLVGNNTPTFFIRDAYKFPDFIHTQKRDPRSNLRSNNAAWDFWSLCPESLHQVTILMSDRGIPASYRHMHGFGSHTYSLINDKNERFWVKFHFKTKQGIKNLTNEEAANLIANDRESHQRDLYEAIEKGDFPKWTFQIQVLKEDEAEKLGFNPFDLTKVWPHSIVPLIEVGELVLNKNVQNYFNEVEQAAFSPSNIVSGIGFSPDKMLQARIFSYPDAHRYRIGTNYHLLPVNRAKSEVNTYNVAGAMNFDTYKNGPAYYEPNSYDDSPKEDKSYLEPDLALEGNAQRYAPLDDDFYTQPRALFDIMNESQKEQLFKNIAASMNGVDEKIIARALSHFEKISSEYANGVKKALKM

SEQ ID NO: 9554 - protein, 756 aa, Solanum tuberosum
MAIVGGLVDVPFENKVEFDDLARFAVQDYNQKNDSSLEFKKVLNVKQQIVAGIMYYITFEATEGGNKKEYEAKILLRKWEDLKKVVGFKLVGDDSTMPGGIVNVPNPNNTKFQELARFAIQDYNKKQNAHLEFVENLNVKEQVVAGIMYYITLAATDDAGKKKIYKAKIWVKEWEDFKKVVEFKLVGDDIAKLGGITDVPFPNNPEFQDLARFAIQVYNKKENVHLEFVENLNVKQQVVAGMMYYITLAAIDAGKKKIYETKIWVKEWEDFKKVVEFKLVGDDSAKTGGIINVPNPNSPEFQDLARFAVQDYNNTQNAHLEFVENLNVKEQLVSGMMYYITLAATDAGNKKEYEAKIWVKEWEDFKKVIDFKLVGNDSAKKLGGFTEVPFPNSPEFQDLTRFAVHQYNKDQNAHLEFVENLNVKKQVVAGMLYYITFAATDGGKKKIYETKIWVKVWENFKKVVEFKLVGDDSAKLGGIINVPFPNNPEFQDLARFAVQDYNKKENAHLEFVENLNVKEQLVAGMLYYITLVAIDAGKKKIYEAKIWVKEWENFKKVIEFKLIGDDSAIIGGFTDVPFPNNPEFQDLARFAVQDYNKKENAHLEYVENLNVKEQLVAGMIYYITLVATDAGKKKIYEAKIWVKEWEDFKKVVEFKLVGDDSAKPGGIIIVPFPNSPEFQDLARFAVQDFNKKENGHLEFVENLNVKEQVVAGMMYYITLAATDARKKEIYETKILVKEWENFKEVQEFKLVGDATK

SEQ ID NO: 9555 - protein, 483 aa, Bordetella bronchiseptica
MCMSTRKFRGFGLVAIGAVAGILLSVGVSAVAQRGSPLPLDELRQLSNVFAAIKNNYVEAVDDKTLIGNAISGMVSNLDPHSAYLDADAFREMQTATQGEFGGLGIEVGAEDGFVKVISPIEDTPAARAGIQAGDLIIKIDDTPTKGMSLNDAVKLMRGAPKSPITLTIMRADRPQPIVVKIVRDIIKVRSVRSKMLDNNVAYLRIAQFQEKTGPDLARHLKELGAKGAPKSLVLDLRNDPGGLLTSAIGVAGAFLPPDALVVSTDGRTPDSRHKYRATPSEYARGEGNYLNDLPGWVKTVPMVVLVNVGSASASEIVAGALQDHKRAKVLGNRTFGKGSVQVILPLSESTAVKLTTSRYFTPSGRSIQATGIEPDYVVADTADGDLFRLPREADLQRHLSNQQSPDAEVKSNNDDNTEVAGKAFEFGGKDDFQLQQALNLLAGKPVQKGSARAQAKADIKPSEGKTQRMTITPTGVEPAKSK

SEQ ID NO: 9556 - protein, 705 aa, Deinococcus radiodurans
MTFPLPLDHEHLQKLVTADLVRPDHLLGAHPTTEHGVQGVRFAVWAPNAQHVSVVGDFNDWNGFDHPLQRLDFGFWGAFVPAAQPGQRYKFRVTGAGGQTVDKTDPYGTFFEVRPNNASIIWQQDFEWTDAGWLEQRARRGQALEDPISIYECHVGSWARRDDGWFLNYRDLAHRLGEYVTYMGYTHVELLGVMEHPFDGSWGYQVTGYYAPTSRLGSPEDFKYLVNHLHSLGIGVLLDWVPGHFPTDEFALAHFDGSPLYEYADPRKGYHYDWNTYIFDYGRNEVVMFLIGSALKWVQDYHVDGLRVDAVASMLYLDFSRTEWVPNIYGGRENLEAIAFLKRLNEVAHHMAPGCLMIAEESTSFPGVTTPTPEGLGFDYKWAMGWMNDSLAYFEQDPIYRKYDHHKLTFFNVYRTSENYVLAISHDEVVHLKKPMVLKHPGDWYAQRADYRAFLAMMWTTPGKKLLFMGQDFAQGSEWNHDAPLPWFHADQPDHRGVMNLVRRLNELYRERPDWHTGDAREEGMAWISADDTDNSVYAYARRDTYSGAWSLVIANLTPVYREDYVIGVPQGGEYRVLLSTDDGEFGGFGTQQPDLSARDEAAHGQAHALHLNLPPSSVLVLEPVAAAPVKGLVSRQELTPELREVARQSAQAVQVERAADPRPNEQQRLVAETPAHEGGRSAPADAAESAEQKPDDEQKGGKKA

SEQ ID NO: 9557 - protein, 576 aa, Triticum aestivum
MLEQVCTKKSLVPVRNSRDIVDPRVRSGTRPRSPCPPPNVLPASSPPHHARTRARALARSRSLGPSLLLCLLAPSARREVPAGRRTRARARSSSLSGPSLLDLRPRREGGAGRPANPRPRARRAGMAASEGAMRMGKYEMGRTLGEGHFGKVRLARHADTGRAFAIKILDRQRILAMKIDEQIKTEIATLKLLKHPNVVRLYEVAASKTKIYMVLEYVNGGELFEKIALKGKLSEKEGRKLFQQLMDAVSYCHERGVYHRDLKPENVLVDAKGNIKVSDFGLSALPQHQRGRVGLHTTCGSPNYIAPEVLLNKGYDGSMSDVWSCGVILYVMLTGNLPFDDENMVVLYQKILKGDYRIPKWLSPGAQDILRKLLDPNPITRLGMDGLREHDWFNQSYTPAVPFDDDDDNYVGDDNSHMTKNNGIPDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKNDSIRQELYRFNSSF

SEQ ID NO: 9558 - protein, 579 aa, Corynebacterium efficiens
MVSLVSMLTSLKYRVWAPRPEDVRLHLNGETLPMTRTDGDWWVADREPAVGDRYGFELFDGTEWSKTVPDPRSQYQPDGVHGLSEVISPDFAWSDDAWTGRILPGSVIYELHVGTFSPSGDFDGVIERLDYLKDLGVTAVELMPVQPFGGNRNWGYDGVLWHAVHSGYGGPVGLKKLVDACHNAGIAVYLDVVYNHFGPDGNYNGMFAPYTAGGSTGWGEVVNINGPESDEVRRYILDAVTRWFEEFHIDGLRLDAVHSLDDNGAFPLLEQMTVASEAIAAATGIPRSLIAESDLNDPRLVTSREAGGYGLHAQWVDDIHHALHTLVSGERNGYYSDFGDTATLASTLEKVFHHTGQVSTFRGRRHGREIRRDVTPASRFVTYTTTHDQTGNRAVGDRPSMNLTPAQQMLKAAVIYCSPYTPMLFMGEEYGATTPFAFFCSHTDDELNRLTSEGRKREFARLGWDPETIPTPSEESTFTDSKLDWSFTPEQENILEGYRTLLRLRRELGMSQPDLLSMEISNGPGWISMANGDGILVANFSDSDVEVPFGGELIYSFTSPEVREDSTVLDAYGFAVLRR

SEQ ID NO: 9559 - protein, 316 aa, Solibacter usitatus
MPAIGLGTFGSDHVSAEQIADVVRDAAVVGYRHFDCASVYRNEDRIGFAFRDIMKGGIRREDLWITSKLWNDKHGEGDVIASCRQSLADLQLDYLDMYLVHWPFPNFHPPGCDVSSRSPDARPYIHENYMKTWREMERLVELGLVRHIGTSNVTIPKLKLILRDARIRPAVSEMEMHPHFQQRELFEFVRAAGIEPIAYSPIGSPGRPERDRTPEDTVDIEDPVIVAIAKRIGVHPAVVCVKWAEQLGATPIPFSTRRRNYLANLQGVVSDPLTAADMEAIAGIDRNCRLIKGQVFLWKQDQTWEDLWDLKGVIAQ

SEQ ID NO: 9560 - protein, 160 aa, Butea monosperma
NKVRMIVDCHAKHVKVLQDEKLTFDLTLCGSTLRAPHSCHLQYMSNMDSIASLVMAVVVNDNEEDGDPDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 9561 - protein, 517 aa, Glycine max; identical to SEQ ID NO: 159

SEQ ID NO: 9562 - protein, 355 aa, Unknown
  Shewanella sp. MR-4
MTIEHAANSVGNLFDTYTLNDTITLKNRILMAPLTRCMADADLVPTDDMVAYYARRAEAGLIISEATIIRPDGQGYPNTPGIFNQAQIAGWRKVTDAVHANGGKIFVQLWHTGRVAHPHFFGGGDVLAPSAEKVEGSVPRMRELTYVTPKAATLEDIQGLVRDYAKAAENAIEAGFDGVEIHGANGYLIDAFLHHDSNRRTDEYGGTPANMSRFALEVVDAIAARIGKDRTGLRISPGAYFNMAVDNRDRAVFDYLLPELEKRELAFVHIGIFDDSMEFDYLDGRVSSYVRANYGKTLVGVGGYSAQSASEAIAADKFDLIAIGRPFIANPDYVARVRQGHELVTYSDEMLASLV

SEQ ID NO: 9563 - protein, 165 aa, Butea monosperma
LFMKTKVRMIVDCRAKHVKVLQDKKIPFDLTLCGSTLRAAHSCHLQYMENMNSSASLVMAVVVNDNDEHGDSSDAVPPQKRKRLWGLVVCRHTTPRFIPFPLRYACEFLAQVFAIHVNKELELEYQIVEKNILQTQTLLCDMLMRDAPLGIVSQSPNIMDLVKCD

SEQ ID NO: 9564 - protein, 477 aa, Listeria innocua
MTESKFPKGFLWGGAVAANQCEGAYLEDGKGLSLVDILPTVEDGRWEALFNPSKALATDYGFYPSHESIDFYHRYKEDIKLMAEMGFKCFRMSISWPRIFPNGDETTPNEKGLAFYDAVFDECHKYGIEPVVTINHFDTPLEVFKKYGGWKNRKCIDFYLNFCEAIFTRYKDKVKYWMTFNEINMILHLPYIGGGLDVTKEANPEEVKYQAAHHQLVASALATKLGHEINPENQIGCMLAAGNTYPMTCNPKDVWKSIEADREGYFFIDVQARGYYPSYTKRFFKEHNINIKMEDGDLDALRDHTVDYVAFSYYSSRLTSADPEKNKETEGNVFATLKNPYLKASEWGWQIDPLGLRITMNTIYDRYQKPLFIVENGLGAVDTVEEDGSINDDYRIDYMREHVREMGEAIEDGVELLGYTPWGCIDLVSAGSGEMKKRYGFIYVDRDNKGNGTLNRSKKKSFDWYKKVIETNGKDID

SEQ ID NO: 9565 - protein, 206 aa, Cryptococcus neoformans
MATRKKHLLKVIILGDSGVGKTSLMNQYVNKRFSTQYKATIGADFLTRELVVDDRVVTMQLWDTAGQERFQSLGVAFYRGADCCVLVYDVNSNKSFEALDGWRDEFLVQASPHDPENFPFVVLGNKIDMEESKRMVSQKRAMTWCQAKGNIPYFETSAKEAINVEQAFQTIAKNALAQEAETELYADYPDPIRIDSESTQNYGCNC

SEQ ID NO: 9566 - protein, 552 aa, Coxiella burnetii
MAAKVLKFSHEVLHAMSRGVEVLANAVKVTLGPKGRNVVLDKSFGAPTITKDGVSVAKEIELEDKFENMGAQMVKEVASRTSDDAGDGTTTATVLAQAILVEGIKAVIAGMNPMDLKRGIDKAVTAAVAELKKISKPCKDQKAIAQVGTISANSDKSIGDIIAEAMEKVGKEGVITVEDGSGLENALEVVEGMQFDRGYLSPYFINNQQNMSAELENPFILLVDKKISNIRELIPLLENIAKSGRPLLVIAEDIEGEALATLVVNNIRGVVKVAAVKAPGFGDRRKAMLQDIAVLTGGKVISEEVGLSLEAASLDDLGSAKRVVVTKDDTTIIDGSGDAGDIKNRVEQIRKEIENSSSDYDKEKLQERLAKLAGGVAVIKVGAATEVEMKEKKARVEDALHATRAAVEEGVVPGGGVALIRVLKSLDSVEVENEDQRVGVEIARRAMAYPLSQIVKNTGVQAAVVADKVLNHKDVNYGYNAATGEYGDMIEMGILDPTKVTRTALQNAASIAGLMITTECMVTEAPKKKEESMPGGGDMGGMGGMGGMGGMM

SEQ ID NO: 9567 - protein, 552 aa, Coxiella burnetii
MAAKVLKFSHEVLHAMSRGVEVLANAVKVTLGPKGRNVVLDKSFGAPTITKDGVSVAKEIELEDKFENMGAQMVKEVASRTSDDAGDGTTTATVLAQAILVEGIKAVIAGMNPMDLKRGIDKAVTAAVAELKKISKPCKDQKAIAQVGTISANSDKSIGDIIAEAMEKVGKEGVITVEDGSGLENALEVVEGMQFDRGYLSPYFINNQQNMSAELENPFILLVDKKISNIRELIPLLENIAKSGRPLLVIAEDIEGEALATLVVNNIRGVVKVAAVKAPGFGDRRKAMLQDIAVLTGGKVISEEVGLSLEAASLDDLGSAKRVVVTKDDTTIIDGSGDAGDIKNRVEQIRKEIENSSSDYDKEKLQERLAKLAGGVAVIKVGAATEVEMKEKKARVEDALHATRAAVEEGVVPGGGVALIRVLKSLDSVEVENEDQRVGVEIARRAMAYPLSQIVKNTGVQAAVVADKVLNHKDVNYGYNAATGEYGDMIEMGILDPTKVTRTALQNAASTAGLMITTECMVTEAPKKKEESMPGGGDMGGMGGMGGMGGMM

SEQ ID NO: 9568 - protein, 368 aa, Pseudomonas aeruginosa
MSLLFEPLSLRQITLPNRIAVSPMCQYSAQEGLANDWHLVHLGSRAVGGAGLVIVEATAVLPEGRITADDLGIWSDAHVEPLHRITRFIESQGAVAGVQLAHAGRKASTWRPWLGKHGSVPIGQGGWIPVAPSAIPFDPQHTTPEALSEAQIEALVQAFVRATERSLAAGFKVAEVHAAHGYLLHQFLSPLSNQRRDQYGGCFENRIRLLLQVTAAVRKAWPEELPLFVRLSATDWVEDGWNPDETVELARRLKDLGVDLIDVSSGGTAANAEIPVGPGYQTEFAERVKKEAGIASGTVGMITEPVQAEHILRTGQADLILLARELLRDPYWPLHAADELRNEQMPWPPQYLRAAHRSTPPRKSLEMQ

SEQ ID NO: 9569 - protein, 159 aa, Glycine max
  misc_feature (133)..(133): Xaa can be any naturally occurring amino acid
DGVWVDRIPAWIKYATVDPTRFAAPYDGVYWDPPLSERYQFKYPRPPKPKALRIYEAHVGMSSFEPRINSYREFADEILPRIRANNYNTVQLMAVMEHSYYASFGYHVTNFFAVSSRSGTPEDLKYLIDKAHXLGLQVLMDVIHSHASNNVTDGLNGFD

SEQ ID NO: 9570 - protein, 449 aa, Bacillus circulans
SIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 9571 - protein, 256 aa, Selaginella remotifolia
ETWLVTTTSSSNPEVGLATGLAATGGAQDLLNPPLNKQKEPPVGRGKIEIKRIENATSRQVTFSKRRGGLLKKAHELSVLCDAQVALIIFSSTGKLFEYASTSMKEILDRYGKYPESVQGGNMASHHEASDFISHEIRRLKQQLQRSQQSRRHLLGDDLSHLPIKDLQNLEQQLEVGLSRVRSRKDQVLMDQVDELRRRELTLHKDNEMLRRRLSDVQGMAESGRSTLIVNPWRQGNLLQTWQMYPCHFLDTKAAA

SEQ ID NO: 9572 - protein, 296 aa, Pinus pinea
SAKGFFEVTHDISHLTCADFLRAAGVQTPLIVRFSTVIHERGSPETLRDPRGFAVKFYTREGNFDLVGNNFPVFFVRDGMKFPDMVHALKPNPKSHIQEDWRILDFFSHHPESLHMFTFLFDDLGIPLNYRHMDGSGVHTFTLVNKAGRQTYVKFHWRPTCGVKCLLDDEAVVVGGTNHSHATKDLYDSIAAGNYPEWKLFIQTMDPRDEDKYDFDPLDVTKTWPEDIFPLQPVGRMVLNKNIDNFFAENEQLAFCPALVVPGVYYTEDKLLQTRVFSFADTQRHRLGPNYLMLPA

SEQ ID NO: 9573 - protein, 399 aa, Saccharomyces cerevisiae
SFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVQLWVLGWAAFPDNLARDGLRYDSASDNVFMDAEQEAKAKKANNPQHSLTKDEIKQYIKEYVQAAKNSIAAGADGVEINSANGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKS

SEQ ID NO: 9574 - protein, 399 aa, Saccharomyces cerevisiae
SFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVQLWVLGWAAFPDNLARDGLRYDSASDNVFMDAEQEAKAKKANNPQHSLTKDEIKQYIKEYVQAAKNSIAAGADGVEINSAHGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKS

SEQ ID NO: 9575 - protein, 90 aa, Lycopersicon esculentum
NRAGKSTYVKFHRKPTCGVMSLLEEEADRVGGANHSHATQDLYDSTAAGNYPEWKIFIQTMDPDHEDRFDFDPLDVTKTWPDDILPLQPD

SEQ ID NO: 9576 - protein, 54 aa, Triticum aestivum
LHVHISPFSAGSDSGASDSRGKRISSLFHPFFPLALSIQQTNMQPTVVNVHFRR

SEQ ID NO: 9577 - protein, 233 aa, Solanum tuberosum
FGYHVTNFFAVSSRYGNPEDLKYLIDKAHSLGLQVLVDVVHSHASNNVTDGLNGFDIGQGSQESYFHAGERGYHKLWDSRLFNYANWEVLRFLLSNLRWWLEEYNFDGFRFDGITSMLYVHHGINMGFTGNYNEYFSEATDVDAVVYLMLANNLIHKIFPDATVIAEDVSGMPGLSRPVSEGGIGFDYRLAMAIPDKWIDYLKNKNDEDWSMKEVTSSLTNKRYTEKCIAYAE

SEQ ID NO: 9578 - protein, 188 aa, Brassica napus
  misc_feature (43)..(43): Xaa can be any naturally occurring amino acid
  misc_feature (155)..(155): Xaa can be any naturally occurring amino acid
  misc_feature (160)..(160): Xaa can be any naturally occurring amino acid
  misc_feature (174)..(174): Xaa can be any naturally occurring amino acid
STQRVRCERICGVLLIEELGLENEAEKPSNALLTRAWSPGWSXADKILTEFIEKQLIDYAKNSKKVVGNSTYLLSPYLHFGEISVRRVFQCARMKQIIWARDKNGQGVESAVLFLRGIGLRDYSRYICFNFPFTHEQSLLSHLRFFPWDADVEKXKAWRXGRTGYSEVDAGMRXELWATGLMHNRIRV

SEQ ID NO: 9579 - protein, 170 aa, Craibia brevicaudata
PQATRFLFMKNKVRMIVDSRAKHVKVLQDQKIPFDLTLCGSTLRAPHSCHLQYMENMNSSASLVMAVVVNDNDEDGDSSDAVQPQKRKRLWGLVVCHHTTPRFVPFPLRYACEFLAQVFAIHVNKELELEYQIVEKNILRTQTLLCDMLMRDAPLGIVSQSPNIMDLVKC

SEQ ID NO: 9580 - protein, 198 aa, Craibia brevicaudata
EDDHGEVIAEITKPGLEQYLGLHYPATDIPQAARFLFMNNKVRMIVDCHAKHVKVLQDEKLLFDLTLCGSTLRAPHSCHLQYMANMDSIASLVMAVVVNDNEEDGDSSDAVQPQKRKRLWGLVVCHNTTPRFVPFPLRYACEFLAQVFAIHVNKEIELEYQIIENNILRTQTLLCDMLMRDAPLGIVSQSPNIMDLVK

SEQ ID NO: 9581 - protein, 279 aa, Triticum aestivum
SGIIIPSLAMKIAKGIEVGDERLTNLKGVIAGNPLTDTTTYFNAQIAFLHRMAIIPDEIYEAAREGCGGEYRWPSNSHCAKSLQDIKECMSGLNDVHILEKICPEYPSLTLHKQPALQDHGRRRLTESAVSSVCRNATYFLSELWTRDEAVRESLGIHKDTVPSWLRCDFNLPYTYEINSTVDDHLALITKGYRAMIYSGDHDSKISYVDTQAWIRRLNLPITHRWRPWHLDDQIVGYTRTYSNNLTYATVKGAGHTAPEYMPRECLAMIDRWLSGEPL

SEQ ID NO: 9582 - protein, 204 aa, Derris elliptica
YKFHEDDHGEVIAEITKPGLEPYLGLHYPATDIPQAARFLFMKNKVRMIVDCHAKHMKVLQDEKIPFDLTLCGSTLRAPHSCHLQYMANMDSIASLVMAVVVNDNEEDGDSSDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 9583 - protein, 145 aa, Derris elliptica
EDDHGEVIAEVKRPGLEPYLGLHYPATDIPQATRFLFMKNKVRMIVDCRAKHVKVLQDKKVPFDLTLCGSTLRAPHSCHLQYMENMNCSASLVMAVVVNDNDEDGDSDAVQPQKRKRLWGLVVCHNTTPRFVPFPLRYACEFLAQ

SEQ ID NO: 9584 - protein, 492 aa, Prunus mume
MGSSSATANRFLLSKIATSEGHGENSPYFDGWKAYDRNPFHPTKNPEGVIQMGLAENQLSFDSIEDWIKKNPKASICTPEGVEEFKNVAIFQDYHGFPEFRKAVAMFMSKARGGRVTFDPNRVVMSGGATGANELVMFCLADPGDAFLVPSPYYPAFFRDLGWRTGVQIVPVDCDSSNNFKITKEALEAAYEKAQKNNINVKGLIITNPSNPLGTTLDRNTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLPSMLLDEEFVARFLETSPKRLAKRHGVFTKGLEEVGINCLKSNAGLFCWMDLRRLLEDQTFDGEMVLWRVIVNEVGPNVSPGSSFKCVEPGWFRVCFANMDDETLEVALKRIRTFVRQGKKAQDQVVQVKSPKRWKSNLRLSFSSSSTRRFDQESVNVLSPHMMSPHSPLVRAKT

SEQ ID NO: 9585 - protein, 241 aa, Populus trichocarpa
MEYQNESLESSPLRKLGRGKVEIKRIENTTNRQVTFCKRRSGLLKKAYELSVLCDAEVALIVFSSRGRLYEYSNDSVKSTIERYKKASADSSNTGSVSEANAQYYQQEAAKLRSQIGNLQNSNRHMLGEALSSLSVKELKSLEIRLEKGISRIRSKKNELLFAEIEYMQKREVDLHNNNQLLRAKISENERKRQSMNLMPGGADFEIVQSQPYDSRNYSQVNGLQPASHYSHQDQMALQLV

SEQ ID NO: 9586 - protein, 253 aa, Nicotiana tabacum
MALETLNSPTTTTPPTFQFENNGQLRYLENWTKGKRSKRPRSMERQPTEEEYLALCLIMLARSDGSANQEQSLTPPPAPVMKIHAPPEEKMVYKCSVCGKGFGSYQALGGHKASHRKLVAGGGGGDDQSTTSTTTNATGTTSSANGNGNGSGKTHECSICHKCFPTGQALGGHKRCHYDGGNSNASVSVSASVGVTSSEGVGSTVSHRDFDLNIPALPEFWPRFGFGEDEVESPHPAKKSRLSLPPKFELFGE

SEQ ID NO: 9587 - protein, 238 aa, Populus trichocarpa
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKNELLFAEIEYMQKREIDLHNNNQLLRAKIAENERKRQHMNLMPGGVNFEIMQSQPFDSRNYSQVNGLPPANHYPHEDQLFS

SEQ ID NO: 9588 - protein, 514 aa, Zea mays
  misc_feature (407)..(407): Xaa can be any naturally occurring amino acid
MDGRRTILMGRYEIGKQLGQGTFAKVFYARNLTTGLAVAIKMINKDKVMKVGLMEQIKREISIMRLVKHPNILQLYEVMASKSKIYFVLEYAKGGELFNKIAKGGKLSEDVARKYFQQLVSAVDFCHSRGVYHRDLKPENLLLDENENLKVSDFGLSALAESKRQDGLLHTTCGTPAYVAPEVLSRKGYDGAKADVWSCGVILFVLVAGYLPFHDTNLIEMYRKISRAEFRCPRFFSTELKDLLHKILVPDPSTRISISRIKRSAWYRKPVEAHAKKNEAETSENTCTGEGTTSVSTECSTSEGNQGPLSLPNLNAFDIICLSTGFNLSGFFEDKYGRREERFTTRQPVTTVFTKLKELAKRLKLKVNKKENGTLKLAAPKEGKKGMLELDAEIFEVAPSLLLVELXKKTNGDTLEYQKLVKEEIRPALKDIVWVWQDDQHQCSQLPESLLSPPETQDELRLSLPQQEGQDFLEAPLPSLSLDQLKSPTAPEQAEQLPQPEQLQTPIAPEEQIN

SEQ ID NO: 9589 - protein, 283 aa, Bacteroides fragilis
MDFKELNNGVKMPIQGFGVFQIPDATECERVVTDALAVGYRLIDTASVYGNERAVGMAIRKSGIPREELFITTKAWISEMGYERTLRALDTSLARLGLDYLDLYLIHMPFGDYYGAWRAMEKLYAKGRVRAIGVCNFEPDRLLDLCHNANVIPAVNQIEVHPYTPQTDAIRTMQELGIQAEAWGPLAEGRNGLFTDDILTGIARKYDKSAAQVVLRWHLQRGVVAIPKSVHRQRMQENFNIGDFMLTPEDMAAIASMNMGYDMILDLHAPEEVQRLYGIECPA

SEQ ID NO: 9590 - protein, 309 aa, Cryptococcus neoformans
MSAPTSFKLNNGVEIPAVGLGTWQAPPGQVQAAVAHALKNGYRHLDCALIYQNEAEVGDGIKESGVPRSEIFITSKVWNTHQPNVADGLRQTLEALQTDYLDLYLIHWPVRLVPNESSGLLPVNPDGSRSVDRDWDQSETWRQMEEVYASGKVKAIGVANWSIPYLEELKKTWKIVPAVNQVELHPFLPQHKLVKYCRDLGILLEAYSPLGSTNAPLLSDPEINAIAEKYKTSPATICISYQVNRGIVVLPKSVSPKRIEDNLKTIPIEKEDMVKLDGMAAAGKAQRINTPKWGWDLGFDDWYGPVKQQ

SEQ ID NO: 9591 - protein, 150 aa, Betula pendula
GVKCLLDDEAIRVGGANHGHATKDLYVSIGAGNYPEWKLYIQIIDPDHEDKFDFDPLDVTKIWPEDILPLQPVGRLVLNKNIDNFFAENEQLVFCPSIVVPGVYYSDDKLLQTRIFSYSDTQRHRLGPNYLQLPANAPKCAHHNNHHEGF

SEQ ID NO: 9592 - protein, 393 aa, Unknown
  Acinetobacter sp. ADP1
MAQRFNYRVFLTSVLMCLSPLSFAAPLIQPSSNVDEDGHELHSAEVPVESIQQFVQIYNLVKDNYVEAKSDDALFQQAIKGLVSGLDRYSRYLSPEDYKQLVQYTEGDLASVDFALVYDARIHQWVVRDLKEGADSYKLGLRNGQNVLKIDGQDLQTLNHDQVHTLLYGSIGTPIQIQTAEMPVSQTLIRNKKIEADVQPILLHNQVLVLKVKVFQQDTANEIKRLLEEYGSPRLKAVIIDLRNNPGGLLSAAVESADLFLNQGIIVSTKSRSEGNQQFQALPSSEFLRLKMGILINHRSASAAEVFTAAMKDHQRAWVIGEKSYGKGVVQKLFPLPDGSALQMTVSHYYTPDGSMIEGKGIQPNQRYPLPADMKDETYLENVADLLLKQPKS

SEQ ID NO: 9593 - protein, 409 aa, Rubrivivax gelatinosus
MPKPIAKSSKLANVCYDIRGPVLDKARAMEEEGQKIIKLNIGNLAVFGFDPPDEIVQDMIRNLSQTAGYTDSKGLFAPRKAVVHYAQEKAISGVTVDDVYLGNGASELIVMSLNALLDNGDEVLVPAPDYPLWTAAVSLSGGNPVHYLCDEASDWYPDIDDIRRKITPNTRAIVVINPNNPTGALYPESLLREIVELARQHQLIIFADEIYDKTLYDGNTHTSIASLADDVLCVTLNGLSKNYRACGYRAGWMVVSGDKRCAKDYIEGLNMLASMRLCANTPGQLAIQTALGGYQSIKDLVAPGGRLTRQRDMAYELLSQIPGVSVVKPKAALYMFPRLDPKLYPIQDDQQFAYELLAEEKVLIVQGTGFNWPQPDHFRVVFLPNSDDLSDAIGRIARFLDHYRKRHSV

SEQ ID NO: 9594 - protein, 481 aa, Pseudomonas aeruginosa
MNGLPMNLIWFRCDLRTTDNSALLAAADGRPCVALYLLSPAQWREHDDAPCKVDFWLRNLGELQRQLAALNIPLLVRDCGHWRQAPEVIGRLCRELGIGAVHVNQEYGVNEERRDQAVGQRLREQGVAFHSHLDQLFFAPGSVLTRTGGYFQVFSQFRKVCHERLYQALPGVRPRPQPQPPHALASDPLPDAVPAFPRPADSLRRLWPAGEEVAQERLRGFADQHLADYHERRDFPALPGTSQLSPYLAAGVLSPRQCLDAALVANRGEFSGGQQGAATWINELLWREFYKHILVGYPRVSRHRPFREETEALRWRQAPAELEAWQQGRTGIPIIDAAMRQLLATGWMHNRLRMVVAMFLSKNLLIDWREGERWFMRHLIDGDLAANNGGWQWSASTGTDAVPYFRLFNPLSQSERFDPRGEFIRHWLPELAGLERKAIHDPSSLGLFAGVDYPRPMVDLKASRERALAAFRNLPPRDGRA

SEQ ID NO: 9595 - protein, 402 aa, Unknown
  Frankia sp. EAN1pec
MSHDRTGVSPPVLLTVGPATATSRASLPAVPVEPAPPAVAAVPVEPSRPVATAVAVRPPTPVGPAAACPPPVSTAGRRTLAKAAVGAAAAGESAASPRAAGAAPELDPRPKSRAEQILLALFLGGPLLAVALAVPFAWGWGLSWHDVVIGAVMYVIGGLGITVGYHRHFTHGAFKARRGLRIALALAGSMAIEMSVIDWVAAHRRHHRFSDRDGDPHSPWRFGPGTRSLARGLLHAHVGWLFAPRRTNAQRYCPDLLADRDIRRISDRFGWLVAVSMLLPPLVGGLWAGSWTGALTAFFWASLVRVFLLHHVTFSINSICHVLGATPFATRDHSGNVWWLAVPSFGEAWHNLHHADPTSARHGVLRGQIDLSAGLIAVFERLGWAHDVRWPDSERIAAKRAA

SEQ ID NO: 9596 - protein, 841 aa, Leptospira interrogans
MIKSLRISCIFFILISFLTFLLNCSQFKQNNPIASNGVIDLSTWNPNIESINLKGNWEFCWDQWIPPNAEESQWKENCNGFYPVPAYWKFYNIPGKNLSPFGKATYRLKVILPTSFHDSYGIRWTEILSAFQIFINNKSVAQIGVLGTDFNTMTPKLKPDRTEIGPQNNQMTIVIWVSNFNHQNHGFWQPIYLGKWEIIRNTQVSHLMMDIASFASVALIGFYHLVLFLFRTRSKEYLFFGLFCISMGIRQLSVEDHAFIIFFPDIDFDFYIRFIYFTVLSIGIFMCMFIKSLFPEEVSSFFINSAIGVFGCSSFTLALPVRVFTEFFSIIFVLISFLPLGLTTYLFKAHKMKRKGATLILIAYLIFSTVVLNDILFTLGYISTGYISYIGITVFIFFQAGVLAQQLTQAFNHSEDLALELKSTLQENIETHNELLALKELQNTNLEFQVQSRTRELLKARDDAEFANKVKSQFLASMSHEIRTPLNGIIGLIEQFKSTPLDENQQYIRNLIQKSGENLLKIINDILDFSKLEEDKINLELHEFYWKETVEETIGIFLYQATQKGLVLSVDYSPDFIDKSVGDKRRITQVLSNLISNAVKFTDSGKIQIRAFSEKIETKIEYKIQVIDSGIGIPREKIDLLFQKFFQLDSSISRKYGGTGLGLAISKKLVELMNGKIHVSQNKSKGSTFEFTVLLSEFVSKDHSTYLPEITDLSSLSPDTFILIAEDDSTNIFLLSGILKKLKIKFELAKDGLEAITKVRVSRFDLIFMDINMPHLDGISASNFILTDPMISPKPVIIAVTADVLQEDKIKCRQAGMSDFLGKPYYKKDIEQMIYKWLVIH

SEQ ID NO: 9597 - protein, 274 aa, Oceanobacillus iheyensis
MEYVTLNNGLKMPQLGFGVWKVPNEEVVSPVEHALKVGYRSIDTAKVYGNEVGVGEAISNSGIPREQLFITTKVWNSDHGYDNTLKAFDESLERLGLDYVDLYLIHWPTPEFDQYVETYKALETLYKDGKVKAIGVCNFDIEYLERILNECEIVPVLNQVECHPYLQQKELRDFCEKHNIYLESYSPLMNGKEVLQSEELQNLAERKGKTVAQTILRWHLQSGMIVIPKSVTPNRIEENLDVFDFELTDTEMQEINELDRNLRSGAVPSEMNVR

SEQ ID NO: 9598 - protein, 1319 aa, Neurospora crassa
MPFITPGQLAFSAMQFLPVPILVLDSLKTVVLANESMGRLLGMPSDATGEGDDLSSTMDQLRGQTLSQVGIDLIQDGMPVWIAWEHFLDQIALEMGVGNSGGKEILKSVLQTDPDGDATPRQAELPPSASTSSPRSRSTSAQSGDGVCDGDAGNTTCRPSPNAVVDVVIVKRDIARSTYHTRARSESSTFHAQAKMIISVWQLSPQQTFFTLTFTNTDSKYVPPVGAKKLAGRRDVLDAAEKKYPYSINDPPSLTSSRDSRSRSPSFPLSPSAVAMSSSPFPPLGPPSHSSITSAPSMLQKITVMKDALLDKTQTPIIAMWKDGSVILPNKPARRLSYPDPVQGAPHEGFNLLSQWRMWTDDFSRQLETDEYPISLMIKSETPFESFRVGMLGPDDERLIFDVEGAVIRDEITGELLAGVITCRDITRIEHEISQIKAADEERFRLICETMPQLVWTAGPDGAHDFYNSRWYSYTGLSVEASLGGGWRTAFHPDDLAEADKRWQNSTRTGEPYVIEYRCRSKDGEWRWFLGRALPLKNKQTGEIEKWFGTCTDVHETMEAKLEAKRTRQQLRSVIAHSRMTMFAVDPNRKVTLLEGSLIWDALSPECGSSSWFIGKDVYEVFNNINQQLPDGQTPAFLQPLESILGGKSPVELQDHKFGRWYRTGFQPILRRDPLTGNSTEDFIEGVMGFIMDVTELKDRERDIEAQALEKRQLLANEAAAKEASRLKSQFLANMSHEIRTPITGVIGMAELLLDVELDAEQRELTENIFRSANALLTVINDILDFSKIESGRLDIEEVQFSLAVVIQEVGKMLSFTAERKSLAFNYEICSDIGIDLVVMGDPGRVRQIITNLATNSIKFTHEGHVKLHVSVEQETDDTIEVKFVIQDTGIGIEEEVLKRLFQPFSQGDPSTARKFGGTGLGLTISKNLLELMKGRMALASKKDEGTTATFWIPFKKPQKAQSITGPLSDRLQSETSVSCNCPAPADQESGALSGEQRSAWRQSSTSLSPTTSQEELSMPDRSKIFILVVEDNEINQQIAIRTIRKLGFQVAAAWNGKEALEYLSKASTGKTRKPDIILMDVQMPLIDGYLCTHLLRHHAPYRSYVRDVPIVAMTASAIQGDKEKCKRAGMDDYLSKPVKRTTLERMLLRWCTTKREELSPITSQCTESGEHCQSAGIPAVGLNEEPSELDLNAYDNVDDHEGSNLATPMGPGRVAEGMSPGGGAEIEQSPTAGYFSSGSGSGHGVPDATKPTGDPGEQTGLGQAEQLLDASSQHYPSQPSVADMTTSPASIERREGEALTEENLGKLQEEQNEELQSI

SEQ ID NO: 9599 - protein, 206 aa, Zea mays
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVAGGNRAQRSSGCC

SEQ ID NO: 9600 - protein, 328 aa, Archaeoglobus fulgidus
MIEIDGSFGEGGGQILRTAVALSCVTGKAVRIRNIRANRPKPGLAAQHLKGIEAAKIISNAEVEGLRIGSTEIVFNPGSVRGGNFRVDIGTAGSVTLIFQTVLLPLLFADRDSTLTVTGGTDVAWAPPVDYFKNVTLRALREMGAECELEVLKRGYYPKGGGMVRLTVRPAEMKGVVYERIDEIVRGVSHCQNLPGHVAERQASSARNFLEERGIRAEIRTEVLKGLSTGSGIVLWSGYKGGSALGERGKRAEVVGQEAAESLYRELMSDAAFDAHLADQVMPFAAMARGRTEYTTSEVTMHQKSNAYVINTFLGKVVKFEGNKIIIK

SEQ ID NO: 9601 - protein, 152 aa, Oryza sativa
WGGEGAGQVLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 9602 - protein, 195 aa, Morus alba
GFFEVTHDISNLTCADFLRAPGVQTPVIVRFSTVIHERGSPETLRDPRGFAVKFYTREGNFDLVGNNFPVFFIRDGIKFPDMVHALKPNPKSHIQEFWRILDFFSHHPESLHMFTFLFDDIGVPQDYRHMDGSGVNTYTLIDKAGKAHYVKFHWKPTCGVKSLLEDEAIRVGGANHSHATQDLYDSIAAGNYPEW

SEQ ID NO: 9603 - protein, 509 aa, Oryza sativa
MEGNARGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYEKDHVCESLRNRLQNEATVAYYLLLDNRFRATSGYLGADYQESLERNLNRFASSESASSNTRHYLPGSSDPHASGLRPHYPVERKWALGLQSRAQPREIMIEVLKALEDLNVCWKKNGQYNMKCRWSVGYPQATDMLDVNHSFVDDSIIMDNGDVNGRLPAVIKFEIQLYKSRDEKYLLDMQRVTGPQLLFLDFCAAFLTKLRVL

SEQ ID NO: 9604 - protein, 371 aa, Archaeoglobus fulgidus
MAIYAFPEFDGESRRASRIYASARYPSRQEGNVFFDSEEVPNLKYADEMPLKIRNFYSVVAFRPSHIFLSRDVLGGRPLYYGSDMSISSFKSYIDGEVYEVMPGEVVKMDYTGEILERRKYAFEDVFRVGREDVNEMADRILNSLSSYKPRVGCIAFSGGVDSSLLAALYDAPLVSVTASDAEEEWLKTAARMLGKEIEILKVGESAIREVVDTVRKTIETGDFLQLSIAVPVYLTMQFAKSLGFTEIIFGQGADELFGGYKRYEGLSEHELEDALVKDLKSIGESNLVRDCKLAYKNEIKLVTPYLCWDVIDAALKIPPEYKVRREGGKVVRKYILRKIAEKFLPEEIAWRDKKAIQYSTGIAKILKKCL

SEQ ID NO: 9605 - protein, 190 aa, Brassica napus
  misc_feature (132)..(132): Xaa can be any naturally occurring amino acid
  misc_feature (142)..(142): Xaa can be any naturally occurring amino acid
  misc_feature (158)..(158): Xaa can be any naturally occurring amino acid
DRIGVCKGIFRTANIKDEDIVTLGDQFPGQSIDFFGALRARVYDDEVRKFVEGLGVEKISKRLVNSREGPPVFEQPEMTLEKLMEYGNMLVMEQDNVKRVQLADQYLNEAALGDANADAIGRGTFFGKSAQXVNLPVPEGCXTDPAAKNFDPTARSDXDGTCVFQLLSFLLLIIKSSVFFFFCFCVIVNW

SEQ ID NO: 9606 - protein, 179 aa, Phaseolus vulgaris
GLHYPATDIPQASRFLFMKNKVRMIVDCYAKHVKVLQDEKLPFDLTLCGSTLRAPHSCHAQYMANMDSIASLVMAVVVNDNEEDGDTDAVQPQKRKRLWGLVVCHNTTPRFVPFPLRYACEFLAQVFAIHVNKEIELEYQIIEKNILRTQTLLCDMLMRDAPLGIVSQSPNIMDLVKCD

SEQ ID NO: 9607 - protein, 242 aa, Corylus avellana
MEFQNQSMSVSPQRKLGRGKIEIKRIENTTNRQVTFCKRRNGLLKKAYELSVLCDAEIALIVFSSRGRLYEYANNSSVKTTIERYKKACADSSNSGSVSEANTQFYQQEAAKLRGQIRSVQDSNRHMLGEALSELNFKELKNLEKNLEKGINRIRSKKNELLLAEIEYMHKREVDLHNNNQFLRAKIAENERNQQNLNVMPGGGNYELMQSQSFDSRNYFQVDALQPNHHYPRQDQMALQLV

SEQ ID NO: 9608 - protein, 404 aa, Aspergillus nidulans
MASQVQPGQKPKVQPCRYKTGKTLGAGSYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGVITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 9609 - protein, 492 aa, Oryza sativa
MDPYKGRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFLSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGSSCRGSTTPTTSCCRRGSSPTPTRSATGWDQNYLVVPANAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 9610 - protein, 336 aa, Pennisetum glaucum
MRMLSKACSLVASSLPRCSSSAAPTIRGQPSLLPSVRKEWLDKPLLYGIGTLLVMPLTTLHGVGRMFGAGRFLCNMTSVSSSLQIELVPCLQDNYAYILHDVDTGTVGVVDPSEATPIINALEKRNQNLTYILNTHHHYDHTGGNLELKAKYGAKVIGSAKDRDRIPGIDITLSEGDTWMFAGHQVLVMETPGHTSGHVCYHFPGSGAIFTGDTLFSLSCGKLFEGTPQQMYSSLQKIIALPDETRVYCGHEYTLSNSKFALSIEPGNKDLQEYAANAADLRKRNTPTVPTTIGREKQCNPFLRTSSPEIKNTLSIPDHFDDARVLEVVRRAKDNF

SEQ ID NO: 9611 - protein, 413 aa, Arabidopsis thaliana
MASSSADNLTDKNIVFRKLKSKSENKVCFDCSAKNPTWASVTYGIFLCIDCSATHRNLGVHISFVRSTNLDSWSPEQLRTMMFGGNNRAQVFFKQHGWTDGGKIEAKYTSRAADLYRQILAKEVAKAIAEETNSGLLSSPVATSQLPEVSNGVSSYSVKEELPLSKHEATSATSSPKASNTVVPSTFKKPIGAKRTGKTGGLGARKLTTKPKDNLYEQKPEEVAPVIPAVSSTNNGESKSSAGSSFASRFEYNDDLQSGGQSVGGTQVLNHVAPPKSSSFFSDFGMDSSFPKKSSSNSSKSQVEESDEARKKFTNAKSISSAQYFGDQNKNADLESKATLQKFAGSASISSADFYGHDQDDSNIDITASDLINRLSFQAQQDLSSLVNIAGETKKKLGTLASGIFSDIQDRML

SEQ ID NO: 9612 - protein, 234 aa, Asparagus virgatus
MGRGKIEIKRIENTTNRQVTFCKRRNGLLKKAYELSVLCDAEVALIVFSSRGRLYEYANNSIKSTIERYKKACADSSNSNAVIEVNSQQYYQQEAAKLRHQIQILQNANRHLMGDSLSSLTVKELKQLENRLERGITRIRSKKHELLFAEIEYMQKREAELQNDNMYLRAKISENERAHQVSVVQPGPEFDTLPTFDSRNYYNVHMLEAAPHYSHHQDQTALHLGYENKADPAA

SEQ ID NO: 9613 - protein, 149 aa, Oryza sativa
MSLVRRSNVFDPFADFWDPFDGVLRSLVPATSDRDTAAFANARVDWKETPESHVFKADLPGVKKEEVKVEVEEGNVLVISGQRSKEKEDKNDKWHRVERSSGQFMRRFRLPENAKVDQVKASMENGVLTVTVPKAEVNKPEVKAIEISG

SEQ ID NO: 9614 - protein, 140 aa, Arabidopsis thaliana
  misc_feature (74)..(74): Xaa can be any naturally occurring amino acid
  misc_feature (95)..(95): Xaa can be any naturally occurring amino acid
MGGIKWTNWSSKGFFFGGQFNRQNLGFKKLKIKSWNQGWFRLWAKNPTWALGTYGNFLWIGWSATHRESGVHIXSFVRSTKLDSWSPEQLRTMMXFGGNNRAQVFFKQHGWTDGGKIEAKYTSRAADLYRQILAKRSAKA

SEQ ID NO: 9615 - protein, 292 aa, Zea mays
FCFALQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTLFFLFDDVGVPSDYRHMEGFGVNTYTFVSAAEKATIRKPNDFKQPGERYRSWDADRQDRFVRRFADSLGHPKVSQELRSIWIDLLAKCDASLGMKIATRLNMKPNM

SEQ ID NO: 9616 - protein, 188 aa, Zea mays
KITPRTRGIVIINPNNPTGAVYSKELLLEIVEIARQHNLIIFADEIYDKILYDEAQHHSIAALAPDLLTVTFNGLSKTYRVAGFRQGWMVLNGPKKHAKGYIEGLEMLASMRLCANVPAQHAIQTALGGYQSISEFIAPGGRLFEQRQRAWELINDIPGVSCVKPQGALYMFPRIDAKKFNIMDDQKM

SEQ ID NO: 9617 - protein, 84 aa, Hordeum vulgare
DDVGIPLNYRHMDGFGVNTYTLISRDGKAHLVKFHWKPTCGVKCLLDDEAVTVGGTCHTHATKDLTDSIAAGNYPEWKLFIQTI

SEQ ID NO: 9618 - protein, 447 aa, Arabidopsis thaliana
MSQHMNLLLPSFETDKEEYDERKTTDHGGIGGSVWRFKGNKAAKEAASVSMKGTLARLFDCCSKDVKKTILPLGHGDPSVYPCFQTSVDAEEAVVESLRSGAANSYAPGVGILPARRAVANYLNRDLPHKIHSDDIFMTVGCCQGIETMIHALAGPKANILLPTLIYPLYNSHAIHSLVEIRKYNLLPDLDWEIDLQGVEAMADENTIAVVIMNPHNPCGNVYTYEHLKKVAEVARKLGIMVISDEVYNQTIYGENKFVPMGIFSSITPVVTLGSISKGWLVPGWRIGWIAMNDPKNVFKTTRVVESIKEHLDISPDPSTILQFALPNILEKTKKEFFEKNNSILSQNVDFAFDALKDIPCLTCPKKPESCTYLVTKLDLSLLEDITNDFDFCMKLAQEENLVFLPGEVLGLKNWVRFSIGVERSMLEDAFMRLKGFFARHTKTQLT

SEQ ID NO: 9619 - protein, 558 aa, Unknown
  Bradyrhizobium sp. BTAi1
MFAAATRSASVRLRPRAIGVERLRRGLAAGLSRSCDVAAQRREILPDRGGRIALDAAVPFDQLRAERGQRRAAAILAAGLPRHRRLPAHPVDLVDEVPGALVGHVHGAAGRRDRAVLLDMLQQRDLARPDAAAVIEVDAQAEGGKGVRFRHGGSARTEVGRTLPPSCFANKMTAIDNHNDSGGEMLPALFSPLTIGPYHLKHRVVMAPLTRMRADRATLAPRQLNVDYYAQRATPGGLIIAEASPVLPTGTGSPNVPGIYSAAQVAGWKQIVDAVHAKGGLIFLQLWHVGRVSHSSFQPGGALPVAPSAIAIGDDLKAMTADGKAAAYETPRALATEEIPGLVAAYGQAARNAMAAGFDGVEVHGANGYLIEQFLQTRSNQRTDRYGGSIENRCRFLLEVTEAVIDACGAGKVGVRLSPYGIANGSGEAEPMPLYTYAIEALNKLGIAYLHLIEPRSSGAGRADVNWQNVPSAIQLFRPVWKGVLIGAGGFTGEPAEAAIKAGHADAIAFGRYFISNPDLPTRLQHGWPLTPYHRPTFYGGEEKGYTDYPVYDATVTA

SEQ ID NO: 9620 - protein, 528 aa, Kluyveromyces lactis
MLSVRVNLKTRISSGMIRVNAPALKSTMPSVTSLTQLRFSTTVKPAPKLSLDDVNENVLKAKYAVRGRIPMRAEELRDQLKKDPSSLPFSKIISANIGNPQQLDQKPLTFYREVLSLLQHPELLEEADEALQTLYKTDSIKRAKRLLSEVGGSVGAYSQSQGVQGIRETVADFITKRDDGEISYPEDIYLTAGASAAVSYILSILCKGPNTGVLIPIPQYPLYTASLALNNSRPLPYYLREEQNWSTDPEEIEQVVLDAIQKGIKPTCLVVINPGNPTGAILSEQSIQKIFEVAAKYGIVVIADEVYQENVFKGSKFYSMKKVLRNLQKTYHGQYDNIQLASLHSTSKGVSGECGQRGGYMELVGFNHDIRQVFLKLASISLCPVVTGQALVDLMVSPPQPGDESYEQDQQEREDIHDALDERASKLFETFSRLEGIECRKPQGAMYLYPKLDLPYKVIQEAQHLEMEPDEFYCKALLENTGICTVPGSGFGQVPGTYHLRTTFLPPGTEWVETWEKFHKAFFDKYRD

SEQ ID NO: 9621 - protein, 416 aa, Unknown
  Vibrio sp. Ex25
MDELICLYCRPSVTPYLQHFAQETSLGRAKLQFLEASLNELNQSLAKLGQRLWTVELTPYQAIKYAISHFGITHIYADAFAGSDEQQALERAIKGTPHVNIKQQAIRTLLREEQLPFELRQLPATFTKFRKQVEGLDLSQPYESVHALPPVPSGMNFPTATTYYFDTKPVFDGGELSGLEHCRRYFASSLASEYKQTRNELDGMEYSTKFSPWLAHGCVSPTIIYAMLKQYEQKNGANDSTYWIYFELLWREYFYWYARKYQQKLFRFGGIANQPPLTSFYAQRFKQWKKGETPFPIVNACMHQLNKTGYMSNRGRQLVASCLVHELGLDWRYGAAYFETQLIDYDVGSNWGNWQYLAGVGADPRGSRQFNLEKQTQTYDPDFSFIDKWQGRCVGVHLDSVDMVDWPIASKKESGR

SEQ ID NO: 9622 - protein, 366 aa, Xanthomonas axonopodis
MLMSKSTQSPLFSPVRLGALDLANRVIMAPLTRNRAVAGQVPSPLAAEYYGQRATAGLIVAEGTQISPLGQGYLDTPGIHTRQQIEGWRAVTDEVHRRGGKIVLQLWHVGRVSHTSVLPPGEVPVAPSAIRAEGKTFTPNGFEDVSEPRALALDEIPGLIEDYRIAARNAIDAGFDGVEVHAANGYLLDQFLRDSSNKRTDAYGGDIENRTRLLAEVVQAIADEIGAERTGVRLSPVTPVYGAHDSDPQPLFERAVERLNLIGGLAFVHVIEGATGGPRDNIAFDYAALRAKFDGAWIANNGYDRGMSEHAISSGYADAIAYGRPFIANPDLVRRLRENAPLAELDQATMYGGGAKGYTDYPALPE

SEQ ID NO: 9623 - protein, 487 aa, Kineococcus radiotolerans
MTTTEERSTTPAPSAAERTFPPGFVWGTATASYQVEGAVAEDGRTPSIWDTFSHTPGRVVAGDTGDVADDHYHRFREDIALMKRLGMASYRFSVAWPRITPQVSADELGPVNPAGLAFYSTLVDELIAAGIEPAVTLYHWDLPQALEDAGGWTARTTAERFAEYAEVVAGALGDRVRTFITLNEPWCSAYLGYASGVHAPGRTEPASALAAVHHLNLAHGLGAAAVRRAAPGARVALTLNLAWVRTEGTSEADADAVRRVDGLQNRVFLDPVLRGTYPADVQADTSSVTDWSFVREGDLALIHQPLDVLGVNYYSPTVVRAWDGSAPRAENDGHGNSAHSPWVASTDVEFPELPGEKTAMGWSIDPRGMTELLLRIHREHPGLELLVTENGAAYDDVVVAGQVHDVERTRYLRDHLAAVLDAVEAGAPVTGYYLWSFLDNFEWGYGFSKRFGVVHVDYATQERTVKDSALWYADVVSRNALPAADAD

SEQ ID NO: 9624 - protein, 453 aa, Thermoanaerobacter tengcongensis
MRKFSIRIFTLLLVFFLAFTSYTYAEVSTQDQDLYNELADIGAIMKYITDNYIDNVTYEQLKEAALKGIFSSLDEYSTYFTKEEFSQFERGTSGTFSGTGMVLIEKDGKIVVDSVIEDSPAAKAGVKSGYIIKTVDGKSVEGMKLTDVVNMILGDPGTKVKITFDVGGTLKEIELVRQVIHINPVSYKLLEEGIGYIKITEFNENTTANLTKALLFMDKNNVKKLILDLRNNPGGLLTEVVSAANFFVPQGIVVTIERRNGEKEDYYSYLTKPKYKLAVLVNKGTASAAEILAGAIQDTKVGFLVGENTYGKGTVQSVVPLEDGSGFKLTIARYKLPSGRYIGKEGLTPDVYVKNVQYTADIKFGGELKIGSRGNEVKILQKYLNLLKFNAGPEDGIFGPKTANAVKELQKKAGLSPTGVFDKNTYNALLKMIDSLNNKDAVLEKALELLRNM

SEQ ID NO: 9625 - protein, 379 aa, Idiomarina loihiensis
MQKISEKPPIIWLNTLVFSITFIVAIVGVPLYAYSVGIGAAFWWVMLGTACFAGLSITAGYHRLWAHRTYDANPVIRFIFAIGGAVALQNSALHWSSDHREHHKHVDDNDKDPYSAKRGFWYSHIGWMIREYQASRYTDYDNVKDLQKDPIVMWQHKYYLPLTLFVNFGWPIAAGFMLGDVWAGLLVIGVLRLVLNHHTTFFINSLAHIWGKQPYTDKNTARDNGVLAFLTFGEGYHNYHHIFAADYRNGIRWWQFDPTKWLIVASKWLGLAKNLKRSSPYQVERAKLQMQLKRAQLKAQAAPESLFERAQEHYDQMGQQLKAYYQARKKLLDTKAKALKEHVHHDIDALKRQVDEMKASLEMQKRSWKALLNQIQQHA

SEQ ID NO: 9626 - protein, 175 aa, Unknown
  Mesorhizobium sp. BNC1
MAETATKLPVKSEKSVASPEGWAPFESLRREIDRLFDDFHPFGWRLPSRTAFDLEIPKFSRAAWQVAPAMDLVEKEKEYEITAELPGIDEKNVEIKLSNHTLTIKGEKKEEKEEKDKDYYLSERRYGSFQRSFRVPDGVDADKIEATFTKGVLTVRLPKTAQAQKADKKIEVKAA

SEQ ID NO: 9627 - protein, 922 aa, Aspergillus nidulans
MASAGPATADGGAGHSHAASGHHLHATNVQSKRRTMIATPTGQWSLGKTLGAGSMGKVKVGKHLETGEQVAIKIVPRQSTEEHRSQREAERADRSKEVRTAREAAIVSLVNHPYICGMRDVVRTNYHWYMLFELVNGGQMLDYIISHGKLKEKQARKFARQIASALDYCHRNSIVHRDLKIENILISKTGDIKIIDFGLSNLFSPRSLLKTFCGSLYFAAPELLQARQYTGPEVDVWSFGIVLYVLVCGKVPFDDQSMPKLHAKIKSGVFEYPPGLTAECRHIISRMLVTDPKQRASLTEIMNHPWMNKGFSGPPDNHLPHREPLQLPLDPEVIEKMTGFEFGKPEYITAQLTKIIESEEYQHAIALNAREHPVPAHTDKKRGVFDFYKRRNSASRDTLSAPSAEAVQLGNDPLNAYSPLLSVYYLVKEKLDRERSESNPGALSIAQAPGDMLQVPDLAPPEAAHTNQYQVPGEKDTGRRSRPRARTHGDDEITEGMKNASLAPNHAQASHSPAASQPDTPAKKESTAAGLLRRFSTRRTKDRSRDRERSRLASPHQPSLNVQPPADSASPLSRGFSMRKNRRTEPSATAIPSTGSQPQHQDLLKTPGSVEPASRSNKYLERSISVSSGEPRHRRSRRTEGDSGSQPPQTSGSEYSAVPKDSTAGREQKIAPRTHASRTMSLGHARRESIQARRARRDAAREANVPEETDGEISGPGAALESANEEDLSKPVYLKGLFSVSTTSSKPLAFIRADIIRVLKQLAVDYVEIKGGFSCRHAPSIELDKVVDNGPPSPERQGQVSNHRRRISLGGLLNHDDGREELARTTTRRRHRAPDRSFVSNSEVSDEYLETRDTTVTSGERVVGETTTRVQSDTGGNLVLRFEILIVKVPLFSLHGIQFKKVSGGMWQYREMAKKILDALRL

SEQ ID NO: 9628 - protein, 375 aa, Lithospermum erythrorhizon
MGNTEKHEETPKMPLLSPYKMAKFQLSHRIVLAPLTRQRSFGNVPQKHAILYYSQRTTRGGLLIAEATGVSDTAQGYPNTPGIWTKEQVEAWKPIVEAVHAKGGIFFCQIWHVGRVSHQNSQPNGQAPFSSTDKPLTSQIRSNGIDVAEFTPPRRLRTDEIPEIINDFRLAARNAIEAGFDGVEIHGAHGYLVDQFLKDQINDRTDQYGGSLENRCRFALELVEAVATEIGADRVGIRLSPYANYMESGDSNPTALGLYMAGALNKYGILYCHMVEPRMKTVGEKTESPYSLMPMRKAFKGTFLVAGGYGKDDGNQAITEGRADLVVYGRIFLANPDLPKRFELDAPLNKYNRETFYIPDPVVGYTDYPFLEDTA

SEQ ID NO: 9629 - protein, 472 aa, Solibacter usitatus
MISGRSLTVAARISEPRQTSEPRPLGSVRLWSRAALLILAAVSCASANDLRLVEALKRRDHKAVTALLAQHADVNAAQPDGATALFWATYLDDRESAELLLAAGAKVEVADEYGETPLTLAAGNGDAPLVAKLLKAGANPSAARWDGETALMIAASAGSVDTVKQLIAAGADVNLAESRKGQTALMWAAAEGHPDVVQYLIDHKAEVNAASKSGFTALVFAAIKDDPKSVQKLLAAGADPNFALPDGAKVLLIAAVHKSPHAAAALADGGADPNIADKGGNTPLHTAARAGDVDLIKKLIEKGANPNARTAKVAPGGRGGGGFRFITGEQTPLMLAAKANKIEAMRALIAGGADPKLKAQDGSTFLMSAVGSGHIEAVQYAYELDPDVKAVSSTGATVMHSSVTGSMQNSTQPEICKVIQFLADKGAALDERDARGRTPIDVADTLPIDKAVELLTELIIKSGATPKKPSRR

SEQ ID NO: 9630 - protein, 125 aa, Taraxacum officinale
NPEALGLYMAESLNQYRIAYCHMVEPRMKKSVGEKIETPHTLVPMRKAFKGTFISAGGFAMEDGNKAVAEDRTDLVAFGRLFLANPDLPKRFELKAPLNKYDRETFYLPDPVIGYTDYPFLETNV

SEQ ID NO: 9631 - protein, 311 aa, Oryza sativa
MRMLSKACSLVASSLPRCSSSAAPTIRGQPSLLPSVRKEWLGKPLLYGIGTLLVMPLRTLHGVGRMFGAGRFLCNMTSVSSSLQIELVPCLQDNYAYILHDVDTGTVGVVDPSEATPIINALEKRNQNLTYILNTHHHYDHTGGNLELKAKYGAKVIGSAKDRDRIPGIDITLSEGDTWMFAGHQVLVMETPGHTSGHVCYHFPGSGAIFTGDTLFSLSCGKLFEGTPQQSNSKFALSIEPGNKDLQEYAANAADLRKRNTPTVPTTIGREKQCNPFLRTSSPEIKNTLSIPDHFDDARVLEVVRRAKDNF

SEQ ID NO: 9632 - protein, 197 aa, Brassica napus
  misc_feature (143)..(143): Xaa can be any naturally occurring amino acid
MCGILAVLGCTDDSQAKRVRVLELSRRLRHRGPDWSGIYQHGDNYLAHERLAIVDPDSGDQPLFNEDKTIVVTVNGEIYNHEELRKDLKNHKFRTGSDCDVISHLYEEHGENFVDMLDGVFSFVLLDTRDNSFMVARDAIGVXSLYIGWGLDGSVWISSEMKGLHEDCEHFEVFPPGVLYSSKSGGFKQWYNPPWYN

SEQ ID NO: 9633 - protein, 482 aa, Pseudomonas syringae
MQLIWLRSDLRVHDNTALTAAMERGPTLAVYLLSPAQWRSHDDADCKVDFWLRNLVELEKALGALNVPLLIREADTWDQAPEVLSTLCTQLKIEGLHLNQEYGINETRRDQAVQKALEKAGVQVTSYLDQLLFKPGSILTKTGNYFQVFTQFKKVCYNRMHQAMPQPVRTPKAQQSLSIKSDSIPDQVEGFATPSKALRDLWPAGEAEARRRMATFADAQISYYKTERDFPAKPGTSQLSAYLAAGVISPRQCLHAALGSNQGEFETGDVGTVTWINELLWREFYKHTLVGYPRVSRHRAFRPETEALKWRDAPEELLAWQEARTGLPIIDAAMRQLLETGWMHNRLRMVVAMFLTKNLLIDWHEGERFFMRHLIDGDLASNNGGWQWSSSTGTDSAPYFRIFNPLSQSERFDPEGVFIKRWLPELADLNKKQIHDPASIGGLFGAADYPKPIVDLSKSRARALAAFKALPARQPAAGIEHD

SEQ ID NO: 9634 - protein, 131 aa, Hordeum vulgare
PNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTDCFNCLPVAALIDDKILCMHGGLSPDL

SEQ ID NO: 9635 - protein, 172 aa, Aspergillus nidulans
MALLRTSRPSRLESFIFSSFLLSSSFSLLSIRTISDPTWVSDLSSLTYYFIPSDIFRLRMSRKLAPEANRILFVKNLNYNVTAEQLFDLFGKFGPIRQIRQGIANNSKGTAFVVYEDVHDAKQACDKLNGFNFQNRYLVVLYHQPEKMLKSKEDLAERQENLERLKQQHGIE

SEQ ID NO: 9636 - protein, 745 aa, Unknown
  Shewanella sp. ANA-3
MMTQAQTYFYDGSDVALLNGQYTDVFSLLGMHSINEGKALVVRCFLRNAQKVDVISLKDGRKVASLERVNEAGLFAGTLGRRVKPFLYALRVVYPLCELDIIDPYQFGSLLDSQDLYLFGEGSSEQAYRFLGANWRHVDNVEGVHFCVWAPNAKRVSVVGDFNHWDDTRHVMRQHMANGLWEIFLPDVAQGAHYKFDLVYQNGERHAKSDPMATQMECAPHNASIVPKKHQHPWADTQWMHKRATTAWHRAAMSIYEVQLGSWRRKGEFGEQYFDYQDLIEQLIPYVKEQGFTHIELMPVSEYPFDGSWGYQPVGLYAPTHRFGDANGLKAFIDACHQAEIGVLLDWVAAHFPKDPHGLVRFDGTCLYEHEDPRKGTHPDWDTLIYNYDRGEVRSFLLSNACYWLREFHLDGLRLDAVSSMLYLDYSREPGQWLPNAYGGRENLEAIHFLQMLNQRLYQAFPGICMIAEESTAFAGVTKPTDCGGLGFGFKWNMGWMNDSLSYLGRDPIYRQYHHNQLTFSLMYAYSEQFMLSISHDEVVHGKGSLLHKIPGDDWQKFATLRAYYGFMWGHPGKKLLFMGGEFAQRDEWNHNHSLDWHLLAFEPHQGVQRWLRDLNWLYRQFPALSVLDYESQGFRWLDCDNGRDSIFSFVRYGEGSDVPLVFVVNMTPTLHQGFRIGLPQGGDFCEYLNSDSHLYGGSNQGNAGKVIAEDLPWQGMASSALITVPPLGCLILGPATDAPRDTSL

SEQ ID NO: 9637 - protein, 438 aa, Zea mays
MAEKENILMQRYEMGKLLGKGSFAKVYHARNVKTSESVAIKVIDKDKIKKCGLMDQIIQEISVMKLVKHPNIVQLYEVMATKTKIYFVIEYVKGGELFKKVQRGRLKEDVARTYFQQLISAVDFCHTRQVYHRDLKPENLLLDGSHNLKISDFGLSALPNCKRKDGLLHTICGTPAYVAPEVISQKGYDGAKADIWACGVILYVLLAGYLPFQDKNMMDMYKKICKAELKWPSWFSSDVRKLLRRILHPNPNRRISIEEIRTHPWFRIGLDARLFDSTTRDYVPSDMDLALNSLNSNMVECNSAAEKLTILNAFDIISLSNGFDLSGIFENSNKESKFMSTNTAMTIITKLMEVAKSLDLKVITKTGGLLNMEAAKSGIKGVMSINAEIFQITPNYHLVEIKKINGDILEYHNFMNQSMRPALEDIVWAWHGEQPDEK

SEQ ID NO: 9638 - protein, 640 aa, Thermoanaerobacter tengcongensis
MELTKPIKLGGIELKNRLVMAPVKTGYATVEGQVTEELIGYYLNRAKGGVGLIVLESAYVDPSGKEIPRQLGIYDDSLVDGLKRLVTPLQEAGSKVAVYINHAGRVANPMATKMPLIAPSAVMCPSIGVEPKAIEKEEIKKWQKAYVDAAIRAYKAGADFLEIQFGHGYLIHQFLSPHANKRQDEYGGSFENRIRFGIEILEEIRSELPGFPVIVRISAEEFVEDGWKLEDTIKLVKILEGKGVAAIDVSLGTMCEAAPITMQTLGTKKGLSWDYAEKIKREVNIPVIAVGRINSPDIAEEILSKGKADLVALGRPLVADPLFLDKAVSGRFKEIRRCLACHQGCFDELRGGRRFGCNINPAVGRSDEIEIPKAENPGKKVFIIGAGPAGLEAAYTAAVRGHKVTIYDENEELGGQLIAASMPPYKEELMGIVEYYKEVLPKLGVEIKLNHRVTAEEVAQWEADAIIFATGGEPIVLSIPGLKEYGYMTAAEVLKEGKETGQTVVIIGGGLIGMETADYLSEKGKKVMVIELLDEVARDMGVFEKNLLMKRLKERDVEIYVKTKLKEVNKSLVTETLEGERNLPLPDTIVLSVGMRPNRTLYEEVKKFVPEEKLYLIGDAKEVRKIVHAISEGRNVALTI

SEQ ID NO: 9639 - protein, 460 aa, Salmonella typhimurium
MRYRFPDNFWWGSACSALQTEGDSLNGGKSQTTWDVWFERQPGRFHQGVGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 9640 - protein, 1115 aa, Ipomoea nil
MENYGKAVTFSSSATSNLNTGKAIAQYNADAKLMAEFEQSRESGKSFDYSRSVIHAPQNVTEEEMTAYLSRIQRGGLIQPFGCMLAIEEPSFKIVGFSENCFDLLGLKSGVEPPERMSLIGIDARTLFTLSSRASLAKAVASREISLLNPIWVHSKINQKPFYAVLHRIDVGIVIDLEPANSADPALLLAGAVQSQKLAVRAISRLQSLPGGDIGTLCDTVVEDVQKLTGYDRVMVYKFHDDSHGEVVSEIRRSDLEPYLGLHYPATDIPQAARFLFKQNRVRMICDCNAQPVKVLQCEELKQPLCLVNSTLRSPHGCHTKYMANMGSIASLVMAVVINSSESMKLWGLVVCHHTSPRYVPFPLRYACEFLMQAFSLQLYMELQLASQLAEKKILQTQTLLCDMLLRDAPFGIVTQTPSIMDLVRCDGAALYYNGKCWLLGVTPTETQVKDIAEWLLHNHGDSTGLSTDCLSDAGYPGAPLLGDAVSGMATARITSKDFLFWFRSHTAKEVKWGGAKHHPEDKDDGGRMHPRSSFIAFLEVVKSRSLPWEDSEINAIHSLQLIMRDSLQGIGENYMKSVSSPQQNDSDGVRFYELSSMALELVRLVETATVPIFGVDSSGLINGWNAKIAELTGLQANVAIGKYLIDDVTHEDSHETFKALMCRALQGEEDRNVEVKLLKFGNHPTKEVVYLVVNACTSRDYKNDIIGVCFVGQDITPEKAVMDKFVRLQGDYEAIIQSLNPLIPPIFASDENACCSEWNAAMERLTGLVKCEVIGKRLPGEIFGGLCRLKGQDALTKFMILLYQGISGHDTEKLSFGFFDRKGNFIDVFITANKRTDERGNIIGCFCFLQTMAVDHPQISARDIEDDRECLSTLKEFAYIQQQMKNPLNGIRFTHKLLEGTVTSDHQKQFLETSEACEKQILSIIENMDSGGIVDGNRVELKTEEFVIGNVIDAVVSQVMIPLKEKNLQLLHDIPDQIKSLPIYGDQIKLQLVLSDFLLSIVRHAPSPDGWVEIRVSPGLKLIQDGNVFIHIQFRMTHPGQGLPSALIEDMVRGGTRWTTQEGVVLHLSQKLVRMMNGHVHYVREQQKCYFLIDLDFKTQKPRSRESSMDTKAD

SEQ ID NO: 9641 - protein, 142 aa, Chlorobium tepidum
MALTLYGKDPLKMFEDVFNERLTPFISSMGSMMAPAFKVDISEDEKAIYLSADIPGVKKEDVKVSIEDDVISISAERTQEEEEKKKNYHRVERSWGSLSRSFTIGDNVDSDNITANYDNGVLKVVIPKKEPEQKKSKEIAVS

SEQ ID NO: 9642 - protein, 129 aa, Schizosaccharomyces pombe
MWLSDLQKIGVGTTALGFLFMIMGIFMFFDGPLLSLGNLLLVFGFFMIAGFSKSVSFFLRKDRMLGSISFFSGLLLTLFHFPIIGFFVECLGFFNLFKVFYPLIISFLRTVPYIGPYIDRLTSYQQSPV

SEQ ID NO: 9643 - protein, 246 aa, Arabidopsis thaliana
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 9644 - protein, 441 aa, Arabidopsis thaliana
DAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 9645 - protein, 492 aa, Glycine max
  misc_feature (193)..(193): Xaa can be any naturally occurring amino acid
MDPYKHRPSSAFNSPFWTTNSGAPIWNNNSSLTVGARGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDXGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAERFPIPPAICSGRREKCGIEKENNFKQPGERYRSWAPDRQDRFARRWVDALSDPRVTHEIRSVWISYWSQADRSLGQKIASHLSTRPNI

SEQ ID NO: 9646 - protein, 404 aa, Haemophilus somnus
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKQQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLAKFLTHYRQ

SEQ ID NO: 9647 - protein, 575 aa, Bacteroides fragilis
MSTKNSSRFTPVIIAISVVIGILIGTFYAKHFAGNRLGIINGSSNKLNALLRIVDDQYVDTVNMADLVEKAMPQILAELDPHSTYIPAQNLEEVTSELEGSFSGIGIQFTIQDDTIHVNSVIQGGPSEKVGLMAGDRIVMVDDSLFVGKKVTNERAMRTLKGPKGTQVKLGVKRATEKDLLNFTITRGDIPQNTIDAAYMLTDDFGYIQVSKFGRTTHVELLNAIALLNHKNCKGLIIDLRGNTGGYMEAAVRMVNEFLPEGKLIVYTEGRKYPRADEFANGTGSCQKMPVIVLIDEGSASASEIFTGAIQDNDRGMVVGRRSFGKGLVQQPIDFSDGSAIRLTIARYYTPSGRCIQRPYQNGKDRNYEMDWLTRYEHGEYFSKDSIKLDENLRYSTALGRPVYGGGGIMPDVFVPQDTTGVTSYLTEVLSKGLTIQFTFHYTDNNRDKLKKYEDEESLLNYLRRQGLVEQFIRYADSKGVKRRNILIQKSYKLLEKSIYGNIIYNMLGKEAYIQYLNQSDQTVKKAVELLESGEAFPKAPISVEPQKEEKKDGKKKTTAQVDSTGEEEILRLYA

SEQ ID NO: 9648 - protein, 1082 aa, Arabidopsis thaliana
MASSSADNLTDKNIVFRKLKSKSENKVCFDCSAKNPTWASVTYGIFLCIDCSATHRNLGVHISFVRSTNLDSWSPEQLRTMMFGGNNRAQVFFKQHGWTDGGKIEAKYTSRAADLYRQILAKEVAKAIAEETNSGLLSSPVATSQLPEVSNGVSSYSVKEELPLSKHEATSATSSPKASNTVVPSTFKKPIGAKRTGKTGGLGARKLTTKPKDNLYEQKPEEVAPVIPAVSSTNNGESKSSAGSSFASRFEYNDDLQSGGQSVGGTQVLNHVAPPKSSSFFSDFGMDSSFPKKSSSNSSKSQVEESDEARKKFTNAKSISSAQYFGDQNKNADLESKATLQKFAGSASISSADFYGHDQDDSNIDITASDLINRLSFQAQQDLSSLVNIAGETKKKLGTLASGIFSDIQDRMLEKKVRKKLCRKTSNESLALSSPNRDRSDDDDNNNNHDSVSIPPPIYDGYSSSSSDESQSVPSPPINLDHDDDECQIPIRNTSQALDDIDDDIWGDDDLPETRRPWTPNVSPGFGSDDDDDNDDDNSKNEPRKSLFYGFRQEPEPVTGVGAGLWNLGNSCFLNSVFQCFTHTVPLIESLLSFRYEVPCHCGNEFFCVIRAIRYHIEAALRPERCPIAPYFFFDNLNYFSPDFQRYQQEDAHEFLQAFLEKLEICGSDRTSFRGDITSQDVFSGRLISGLRCCNCDYVSETYEKSVGLSLEIEDVDTLGSALESFTRVEKLDEQLTCDNCNEKVSKEKQLLLDKLPLVATFHLKRFKNNGLYMEKIYKHVKIPLEIDLQPYMRNIQENEVSTKYHLYALVEHFGYSVAYGHYSSYVRSAPKIWHHFDDSKVTRIDEDMVLSQDSYILFYAREGTRWFSSVYEEMQPLVEASLLNSSPKSVLDSSTNGECLSEISYENGDKASKPCDSAGVCNQHVKTKEDFVSLSNDDVFLSAESSSGEESPMGELLDPLDPDDSYSPCTEKESDSCLAIERATIRDDFFPLLLDQNQESSTSSPKLQERTFEMQLLQMEETTKSQEPWKQPLSSISNIADSMEAEFVYGDLMKKPSPRARELLDQAISTNGSPPKKLKTT

SEQ ID NO: 9649 - protein, 236 aa, Escherichia coli
MGYRSFDTAAAYKNEEGVGKALKNASVNREELFITTKLWNDDHNRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 9650 - protein, 590 aa, Unknown
  Bradyrhizobium sp. BTAi1
MCGICGEVRYSSPPLLHALSRMNDAMQARGPDAAGLYVQGGVALGHRRLSILDLSAAAQQPMIDAAFGLGIVFNGCIYNFRELRTELQAKGYRFFSDGDTEVILKSYHAWGKGCVQRFKGMFAFALWERDSGRVVLARDRLGIKPLYYAEGAGFFRFASSMPALLAAGDVDTSLDPTALHHFFSFHAAVPAPRTILNGVKKLAPATLLTIDPDGTQHRERYWSFNVGEQRPTDRAMSQEEWSDALLDEMTVAVDRRRVADVPVGVLLSGGLDSSLLVALLSKLGHQDIRTFSIGFDAVDEHSGDEFRYSDIIARTFGTDHEQIRIGGDRALEALPNAIAAMSEPMVSHDSVAFYLLSSEVAKRVKVVQSGQGADEVFGGYSWYPGFLAANDAVHQYQNAYFDWQHGDLRRLLAPDLLGDDVSLELVERFFADHAGVSAVDKVLQIDTEIMMVDDPVKRVDNMTMAFGLEARVPFLDHEVVELAARMPAELKVTHGGKHILKEAARRCVPAEVIDRPKGYFPVPSLRYLRGPFLAYVRDVLSDEKARSRGLYQRDFIDHMLQNPEAEMSPKGHSRLWQAGLLEAWLQTHGL

SEQ ID NO: 9651 - protein, 298 aa, Xanthomonas axonopodis
MDSQTDEPLDEARADRIDWLRAVPFIALHLACLAVFWVGASWFAVGMAVALYALRMFALTGFYHRYFSHRAFKTSRVLQFVFAAIGATCVQRGPLWWAAHHRNHHRHTDTGRDPHSPAQHGFWWSHTGWFLTPRNFRTDWEVIPDLRRFAELRFLDRFDIVMPVLLALGLYLLGDWLAVAAPALKTSGAQLLVWGFVISTVALFHATFTINSLAHRFGSRRFDTRDDSRNNWLLALLTFGEGWHNNHHFFPGSARQGLRWWEYDMTWYGLTAMSWVGLVWDLKPMPKLLTQRAERVKR

SEQ ID NO: 9652 - protein, 109 aa, Glycine max
  misc_feature (28)..(28): Xaa can be any naturally occurring amino acid
  misc_feature (44)..(44): Xaa can be any naturally occurring amino acid
  misc_feature (80)..(81): Xaa can be any naturally occurring amino acid
EIFGGYLYFHKAPNKEEFHIETYHKIKXLHQYNYLRANKSTFTXNLEAHIPFLDKAFINTTISINPKSKIIKRNKRRIKXXILKRAFNNKEHPYLPKHILYRQKKQFSN

SEQ ID NO: 9653 - protein, 134 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEECASA

SEQ ID NO: 9654 - protein, 370 aa, Burkholderia vietnamiensis
MTALFSPFTLRGVTLPNRIVISPMCQYSAERGEATDWHMIHLGHLALSGAGLLCIEATAVEPDGRITAGDLGLWDDATEAALAPVLAAIRKHSPVRVAMQLSHAGRKASSEVPWKGGQLVSVADGGWLPHAPSAVSHKDGETPPLALDTAGLNRIRDAFAAAAKRAARLGIDAIEVHAAHGYLLHQFLSPLANRRTDEYGGSRENRMRFPLEIFDIVRAAFPDDRPVGVRVSATDWVEGGWELDDTIAFAHALKQRGCDWIDVSSGGVSPLQKIPLSPGYQVPFAQAVKRAVGMPTVAVGLISEPAHANRLIEAGDADFVAMARAMLYDPRWPWHAAAELGAQVSAPPQYWRSQPREHKALFGDVAFGQR

SEQ ID NO: 9655 - protein, 206 aa, Triticum aestivum
  misc_feature (185)..(185): Xaa can be any naturally occurring amino acid
  misc_feature (199)..(199): Xaa can be any naturally occurring amino acid
MVAAAMQALFDQTDLSLSLSLAPTAAPALNKDDYLAICLAALAATGKGGQQQQDQASAWRPAPAPAQELRFSCAVCGKAFASYQALGGHKSSHRKPPPTGERCVVVAQASAGAGSEASAAASSGGSSGGPHQCTVCGRGFATGQALGGHKRCHYWDGTSVSMSMSVSVSASSSMLRNFDLNLLPXPENAGLKRWAEEEXEVQSPLP

SEQ ID NO: 9656 - protein, 353 aa, Cryptococcus neoformans
MSGLSYCPRVGGYLKLSRTPTFTILPIFNSLIMSAPTSFKLNTGASIPAIGLGTWQAKAGEVRQAVAHALKAGYRHIDGALCYQNEDEVGLGIKDSGVPRSEIFLTSKVWSSYHDRVEECLDTTLKSLQTDYLDLYLIHWPVRLAPNGTHPLFPVKPDGSRNLDWDWDQAKTWAQMEDVLKKGKAKAIGLSNAGIPIIEHIIKTGKVTPAVNQVELHPYCPQHALLKYCKEKGILLEAYSPLGSTSSPLHEDPDLLAVAKKHNVPTATVLISYQVNRGVVVLPKSVTPARIESNLKTIKLDEEDMNKLDKLAEGGKQTRFTAPPWGSDFGFPDWFGPGNKDAPEGARLLAGKA

SEQ ID NO: 9657 - protein, 229 aa, Glycine max
  misc_feature (138)..(138): Xaa can be any naturally occurring amino acid
SSRIGSSTRRQKGDNSSQLRSAPPRKKREMATETKVQELGGITDVHGAANSVEINNLARFAVEEQNKRENSVLEFVRVISAKQQVVAGVNYYITLEAKDGLIKNEYEAKVWVREWLNSKELLEFKPVNVSSTPIGGIXRVTANSLEIDILARFAVDQHNKKENANLEFVGVIRAKQQVVEGFIYYITLEAKDGETKNVYETKVWVRSWLNSKEVLEFKPISINPLSVSV

SEQ ID NO: 9658 - protein, 138 aa, Cryptococcus neoformans
MWLSDGQKIGIALVAFGIFFQFLGIILFFDGPFLALGNILFLSGLPLIIGLTKTFYFFSRREKWRGTLCFFGGIILVFAKRPIIGIIIEFVGFIGLFGSFFPVILQALRQTPFIGPILSLPYIRGAADRLAGVRQSAV

SEQ ID NO: 9659 - protein, 741 aa, Pseudomonas syringae
MNAPDKTGTRRRAIPAAVDLDALIRAEHRDPFSILGPHGDGGSGQYVRAYLPAALSVRLLARDDGRELGEMEMSEVPGFFVGHLEHPQPYLLKINWAGGEQITEDPYSFGPLLGEMDLYLFAEGNHRDLSSCLGAQVTSVDGVDGVRFAVWAPNARRVSVVGSFNSWDGRRHPMRMRHPTGVWEIFVPRLQPGEVYKYEILGAHGILPLKSDPMALSTTLPPDTASKIAAPLQFEWNDQEWLQSRAGRHEVTAPLSIYELHAGSWQMEQVEDNQWRQYNWRELADRLIPYVKELGFTHIELMPIMEHPFGGSWGYQLLAQFAPTARYGSPEDFAFFVDACHRAEIGVILDWVPAHFPTDTHGLAQFDGTCLYEYADPKEGFHQDWNTLIYNLGRTEVHGFMLASALHWLKHYHIDGLRVDAVASMLYRDYSRNAGEWVTNRFGGRENLEAIDFLRHLNDVVALEAPGTMVIAEESTAWPGVSEPTQQGGLGFNYKWNMGWMHDSLQYMEEDPINRGHHHGKLSFSLVYAWSERFVLPISHDEVVHGKHSLIDKMPGDRWQKFANLRAYLSFMWTHPGKKLLFMGCEFGQWREWNHDRELDWYLMQYAEHVGVKNLVGDLNRLYREEKALHERDADPAGFQWLVGDDSANSVFAYLRWSNDGEPLLVVANMTPVPRLDYRLGAPMRGAWTELLNSDAETYAGSNFGNGGEVMTEAEPAHGMEDSLVLNLPPLAVLILKPKKD

SEQ ID NO: 9660 - protein, 462 aa, Bacillus clausii
MTTYLFPPDFWWGTAVSATQIEGAADRDGKGKNIWDHWYEIEPNRFFNEVGPAKTSQFYDRYKDDIALMKKLGHTSFRFSISWSRLIPAGNGAVNEKAVQFYDQVIDELLAAGITPFVNLFHFDMPMAMQKIGGFENREVAYAFARYAEICFTHFGDRVKTWFTHNEPIVPVEGGYLYEFHYPKVVDFKRAVQVGYHTMLSSALAIERYRRLGQGGKIGIILNLTPSYPRAEENERDVEAAKLADAFFNRSFLDPSVKGTFPQELVAILKQYGLMPHVEEGDKAVISGNTVDLLGVNYYQPRRVKAKETPIGDGPLMPGTFFDSYDMPGKKINPHRGWEIYEKGIYDLLMNIKDHYGNIECFISENGMGVEGEEKFRDEAGVIQDDYRIEFISNHLRWLHKALTEGANVKGYHLWTFMDNWSWTNAYKNRYGFVSVDLEKDGKRTVKKSGWWFKTVIENNGF

SEQ ID NO: 9661 - protein, 231 aa, Kluyveromyces lactis
MKRYSVSYVEVWDGDRVLSSWYDSKDENNSKYGSTDKGRADQKAVFHRLIGDMVIRTVVNLPGNKVTKTSIDLIEGYDCYYTTAENNKVLICFVKEEVPKFLPLRLLSELKCLNNDNDEYLKSNIDNQLDKFHEELLSYRTEGQQTAASTEEELQNIIAIMNDNIDKFLQRQERISLLVDNTNQLNENSFKFQRKSSKIMRKMWWNNVKFYSIVIIVVLAIIVIVSLLLLH

SEQ ID NO: 9662 - protein, 185 aa, Zea mays
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 9663 - protein, 1112 aa, Kluyveromyces lactis
MNGNGITTLKGDTIGPWKLGSTLGVGSTGKVVMAYNETKGQQAAVKIISKSIFNAQGSTMIGGNDPDVLPYGIEREIIIMKLLNHPNVLRLYDVWETSKDLYMVLEYVEKGELFNLLVERGPLPENEAVRFFRQIIIGISYCHALGIVHRDLKPENLLLDHKFNVKLADFGMAALESKDKLLETSCGSPHYAAPEIVSGLPYHGFESDVWSCGVILYALLTGRLPFDEEDGNIRNLLLKVQSGKFEMPGDDEISSEAQDLIARILTVDPEQRIKTREILKHPLLRKYPSIKDSKSIRNLPREDTYLNPLSLEGGNQCVDETILQNLVVLWHGRNKEDIITKLMEPGANLEKTFYALLHRFKHDNYQDQLKQQELQKKQSVSSNSLMYVGSLPSPNKSDSPVTTPKKKRTSIIVASSSHKRPVSMQKLSSQHSSPVKNGSIGKRLSKTFPSNKRISQLVSNSSSPTPAAHKRVSRINDSAAPPVPKEMLRDYKRQSKRQSKRFSLLPNMKRGSITTKLIATYAKLSEDSEWEYIEKETKRTSQDFATLMDQIFEHEKYEQIRKEKEELERKVNEAREKEEAERKERERIEREEQERLEREERKRAERQKELQDQMEDEIAKLKAEYEAVQGSSDERNTANGRSVSAPIETDRTANKRDSTFGIKNDINELINTRNFSLQTRPVSRLDPGIIAAESRLSANLEDDQASKEKTILETIRRSKFLGSQFNLNVELEKAQKDLVSKERQEQLRKYSEQTAKYEVQKLPKNAKAVATLRDDEVEPRKLSEVKVPQFTRRSKHFSSSNKRFSVLSLYSTKTSFTNLVDHLKNDNYLEPLPGQPEYSSSKVAQEPEFMFETVEELDENSKLFEVPETEEGKLASAARKESTDARKQSTNDKDINLPSLPPLQVSHDVADENGALGLGIYQPNDQTQKPHKTMLIDESIDENISSTSDVSRTEVVKKPPLNDVVRKNNNERKPLEEITPKVENKRKISFFRKFSQGSEKKLGPESFDSQLKAGVSAPKMYKALDRLLNEWTNYGLKHVESSPNDFVISGKLTSDNILSLRSTGFKITVLPGEGNGSIIQFTKKSGSTKTFNRLVKEIEKILEKEKVLVFSF

SEQ ID NO: 9664 - protein, 545 aa, Methylococcus capsulatus
MAAKEVKFSDDARTRMLRGVNILAHAVKVTLGPKGRNVVLEKSFGAPTVTKDGVSVAKEIELSDKFENMGAQMVKEVASQTSDVAGDGTTTATVLAQSILTEGLKAVAAGMNPMDLKRGIDKAVAAAVDEIHAMSVPCTDSNAIAQVGTISANADESIGKIIAEAMDKVGKEGVITVEDGSGLENQLDIVEGMQFDRGYLSPYFINNQQSMSAELENPFILINEKKISNIRELLPVLEGVAKAGRPLVIVAEDVEGEALATLVVNNMRGILKVAAVKAPGFGDRRKAMLEDIAVLTGGTVISEDIGLSLEKATLADLGTAKKVQITKENTTIIDGAGSSEAIQGRVAQIRKQIEDTTSDYDREKLQERLAKLAGGVAVIKVGAATEVEMKEKKARVEDALHATRAAVEEGIVPGGGVALIRALAKLRDLKGANHDQDVGISIARRAMEEPLRQIVANAGDEPSVVLNKVAEGAGNFGYNAATGEYGDMVAMGILDPAKVTRSALQNAASVASLMITTEAMVAEEPKEEAPMPGGMGGMGGMGDMM

SEQ ID NO: 9665 - protein, 205 aa, Volvox carteri
MSTKKRRVLKIIILGDSGVGKTSLMNQYVQKKFTKEYKATIGADFLTKEIEVDDKKVTMQIWDTAGQERFQSLGSAFYRGADCCMLVFDVNNAKSFDDLDNWRDEFIIQAGPSDPDNFPFVVLGNKIDEVGVNRQVTEKKAKAWCASKGSIPYFETSAKEDINVEAAFTCITRNALRNEKEEELFVPDAVDMNTSATQRKRGGCC

SEQ ID NO: 9666 - protein, 311 aa, Glycine max
MATHFVLNTGAKIPSVGLGTWQSDPGIVGEAVYAAVKAGYRHIDCARAYNNEKEVGLALKKLFEESVVKREDLFITSKLWCGHHAPEDVPEALGDSLDDLQLDYLDLYLIHWPFRVRKGTSIGNPENFLPPDIPATWGAMEKLHDAGKARAIGVSNFASKKLGDLLAVARIPPAVDQVECHPGWQQSKLHTFCQSAGVHLSAYSPLGSPGSTWMNGNVLKEPVVLSIAEKLGKTPAQVALRWNIQMGHSVLPKSVSEERIKQNLAVYDWSIPEDLLAKFSEIKQARLLMGNFIVNKDSVYKTHDELWDGEI

SEQ ID NO: 9667 - protein, 409 aa, Kluyveromyces lactis
MVMPVKLEKSDQVAFWTPKQPEVGKFLRYFDGIERDAPLLFQPLTIRGMTISNRVGTSPMCTYSSENFEANKYHLVHYGSISSSGPGLVIVESSAIDQIGASSPNDLGLFTDEQAITHKENIVDWAHVHNIKIGVQLGHAGRKASLASPLNGELGVYVPNEEGGWLDKLVAPSTVPFDDSGVIPNELTLAQIEKTIKQYGISAKLAVEKAGYDFVEIHAGYGYLPCQFYTATANKRNDRYGGPFENRIKFLLEVIDEVRSSIPDSMPIFLRLCADENVEDPDGWKLNDTIRLLPFLVQHGVDVIDVCSGGLNSKEYGWDHPNFLPPREIAKRIKEAAHSKILVASTGGLQDGTTANSLLESNTVDILLIGRVYLKNSGIIWQLADDLGVQLEQAKQKAWIFDSEGHLKK

SEQ ID NO: 9668 - protein, 420 aa, Arabidopsis thaliana
MGENGAKRWNFGANEVVERSNSLTIRDYLNTLINCLDGGDVRPVIPLGHGDPSPFPSFRTDQAAVEAICDAVRSTKFNNYSSSSGVPVARKAVAEYLSSDLSYQISPNDVHITAGCVQAIEILISALAIPGANILLPRPTYPMYDSRAAFCQLEVRYFDLLPENGWDVDLDGVEALADDKTVAILVINPCNPCGNVFSRQHLQKIAETACKLGILVIADEVYDHFAFGDKPFVSMAEFAELVPVIVLGAISKRWFVPGWRLGWMVTLDPHGIMKDSGFVQTLINVVNMSTDPATFIQGAMPDIIGNTKEEFFSSKLEMVKKCAEICYEELMKIPCITCPCKPEGSMFTMVKLNFSLLEDISDDLDFCSKLAKEESMIILPGQAVGLKNWLRITFAVELELLIEGFSRLKNFTERHSKNQP

SEQ ID NO: 9669 - protein, 625 aa, Lactococcus lactis
MCGIVGFIDRMNQNDKSKTLEEMMNTIGHRGPSSSGEFIDEGAAIGFRRLSIIDLEGGDQPIFNEDKSKLITFNGEIYNFRELREDLIAKGHDFTTHADTEVLLHGYEEYGVELLQKLRGMFAFVIWDREKQELFGARDHFGIKPLYYTQMGGTFMYGSEIKSFLKHPNFKKELNKEALKPYMTFQYSALDETFFKNVFRIKEGHYFTYKDGVLDIKPYWDMKVDEKDMSLEESIDLIDKTVLGSVDAHKFADVEVGAFVSSGVDSSYVASTLRPEHTYSIGFGQGTFNESKQAKQLTDMIGLNNTSREIHGDEAFKYFPQIQYYLDEPDSNPSCVPLFFLAELAARDVRVVMSGEGADELFAGYESYGFSTNSRAVRVFAEGLKKLPKSLRFSIARGIENKHFKGQKHLYESLAPAEDFFIGQAKVFDESESVELLKEEFKAAPTVKDIVGKTYKKAPEGSELRKMQYLDMHQWMPGDILLKADKMAMAHSLELRVPLLDIELMHTAEQIPTKYLLNEHNTKYAFRQAARRHLPEEWSNRKKLGFPVPIKDWLREEKYYKVVRQLFEQDFVAEFFDQEKLLKMLDDNFADKNDARRKLWTIYSFLTWYDVYFINNGEKPAVVNF

SEQ ID NO: 9670 - protein, 254 aa, Unknown
  Magnetococcus sp. MC-1
MTIPLEVTPLPAWEDNYIWCFPTEPGAVAVVDPGQAEPVTDYLQQHGLRLSHILLTHHHGDHIDGVAPLQRKHHARVLGSALDAHRLPPLDEALRGGQTFCLGPHQVDTYHTPGHTSGHLCYHIADCLFAGDTLFSYGCGRLFEGTPQQMWQSLLILRALPETTRLCCAHEYTLTNLRFARSLPGQQEPLAAPWQRAQQTRQLGKPTLPSRLAEEKQYNPFLRCDDTQFRTAVGQQAASAEACFAYIRQLRNHF

SEQ ID NO: 9671 - protein, 371 aa, Ralstonia eutropha
MSHLFDPLDIGNLTLPNRIIIAPMCQYSAQDGNAVDWHMIHLGSLALSGAGMLILEATAVSPEGRITAGDLGLYSDENEAALGHVLKAIRAHAPIAVAIQLGHAGRKASSQVPWEGGQQVAPDAPGGWQAVAPSAVPHAEGEARPTALDRAGMDKVRDDFVAAAVRAVRLGIQGFEIHAAHGYLLHQFLSPLANHRDDEYGGSLENRMRFPIEVFDAVRAAVPADRPVWMRISATDWVPGGWDIEGTVALSQAVKARGCAAIHVTTGGVSPAQAIKLGPGYQVPYAQRVKAKVGLPTIAVGLITEPEQAEAIITGNEADAVSLARAMLYDPRWPWHAAAKLGASVAAPKQYWRSQPRELKDLFSGANFGQR

SEQ ID NO: 9672 - protein, 251 aa, Prunus persica
MGRGRVELKRIENKINRQVTFAKRRNGLLKKAYELSVLCDAEVALIIFSSRGKLYEFCSSMSMLKTLEKYQRCSYGSLEANRPVNETQNSYQEYLKLKARVEVLQQSQRNLLGEDLAPLNTKELEQLEHQLEASLNQIRSTKTQFMLDQLCDLQNKEQMLVEANKALRRKLEETSGQAPPLLAWEAAGHGNNNVQHTGLPHHPHSQGFFHPLGNNSTSQIGYTPLGSDHHEQMNVGNHGQHVNGFIPGWML

SEQ ID NO: 9673 - protein, 362 aa, Arabidopsis thaliana
MDRPAVSGPMDLPIMHDSDRYELVKDIGSGNFGVARLMRDKQSNELVAVKYIERGEKIDENVKREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKVADVWSCGVTLYVMLVGAYPFEDPEEPKNFRKTIHRILNVQYAIPDYVHISPECRHLISRIFVADPAKRISIPEIRNHEWFLKNLPADLMNDNTMTTQFDESDQPGQSIEEIMQIIAEATVPPAGTQNLNHYLTGSLDIDDDMEEDLESDLDDLDIDSSGEIVYAM

SEQ ID NO: 9674 - protein, 518 aa, Crocosphaera watsonii
MQDITRRVGNVSTDFKIVNSWVVILPTLLIVNCTLLNYNLSSMTNSVIFWHRRDLRVSDNIGLSKAYQHSSKLVGLFCLDTDILNQDNVAPARITYMLGCLQDLRESYQQLGGQLLIFQGNPTQIIPQVADALKVDCVFWNNDVEPYSKKRDNQVIEALQERGIHSQTYWDQLLHAPGDILTKSNNAPYKVYTPFWRSWLKEEKANIAQALGKLESLSEEEINTVKNLGIIDLPTAKDLGYSWDAPLILEPGETAAKEQLNYFCDSLIYNYQEQRNYPGINGTSTLSPAFKFGVIGIREVWQATLSAYENTYSDEARENIQTWQQEIAWREFYQHCMYFFPELATGPYRQEFKDFSWDNNEQHFQAWCEGKTGYPIVDAAMRQLNETGWMHNRCRMIVASFLTKDLIINWQWGEKYFMQKLIDGDLSANNGGWQWSASSGMDPKPLRIFNPASQAQKYDPDGEYIRLWVPEISSLDTEYLVTGKIPPLEAHSCGYLQPIVDHKQQQREFKERYKQIKN

SEQ ID NO: 9675 - protein, 1005 aa, Cryptococcus neoformans
MTSFNPAPAQIQAAQDHTYGSMPTPTYMGMVDTGAQWDYVGRRGSSRSREPSASPQRAATESGIPRTSTHAASASASSSYAPVAGASGQASSAPHEPTIREEATAVVDRSMRAHQQTTGPSNGNGNSQPKKSKVRMVGDWQLNKTLGAGSMGKVKLATNIVTKEKCAVKIIPRYTDANRKEETTRTPEEVEKQRLKDESKEIRTIREAHISLLLHHPYICGMREFISHQNHHYMVFEFIDGGQMLDYIISHGRLRERAARKFARQIGSALNYCHQNSIVHRDLKIENILISKNGNIKLIDFGLSNLYSPSRHLSTFCGSLYFAAPELLNARPYTGPEVDVWSFGIVIYVLVCGKVPFDDQSMPALHAKIKRGVVEYPSWLSAEVKSLLSRMLVTNPAERATLAEVLSHPFMTKGYDGPPDSFLIRRELLRAEEIDMNVVEAMEGFTFGDANTIYRNLHSILTSEDYLHCVATFEAHREKLRTSSPGVSTNDPSDSPKKKRFSGFDLKKRLFKEDKKVEEAPFKEKVRDPTKGYDPLISIYFLAREKIERERVFGPGFFASSQLSLDTFNTSQGYGMAVPNLPPPASTHVMGHDSSRGPDFASEPRPRSDDVPNPVLAHPSADREQSKLADIPSAVHRRQPSLSQPPLPSSMPAAVERSADEGLTKKFSMLGRGPRPPSAGPSGPSRSASTKRESMTASPSMPIQEHRRATTVVHSDKSKQERRVSVGSFTNSVSKASGLARRASQRDRPPATPPDSRWLNAPAEAEEYHQVETSVRPSSTPREPEPDTANEPRSYDDVKPSYLKGIFSVSTTSTKPANVLIRDIAMVLDRIGIKHRPIKGGFECVHMPSIDLASVVNGDEASTSLSNVPSHASGARRKQSLRRKGSKVNMNGISSNGAGSRATSPGPHRVLTGNSSGTVSGGDVAHLSVPSGKNRHHVGTVEEDEVDAWALAQSGGAGSSLIVRFEIFVVKVPVLPLHGIQFRRVGGDGWQYQMLAKAILREMRL

SEQ ID NO: 9676 - protein, 588 aa, Zea mays
  misc_feature (560)..(560): Xaa can be any naturally occurring amino acid
  misc_feature (572)..(572): Xaa can be any naturally occurring amino acid
MCGILAVLGCSDCSQARRARILACSRRLKHRGPDWSGLYQHEGNFLAQQRLAIVSPLSGDQPLFNEDRTVVVVANGEIYNHKNVRKQFTGAHSFSTGSDCEVIIPLYEKYGENFVDMLDGVFAFVLYDTRDRTYVAARDAIGVNPLYIGWGSDGSVWMSSEMKALNEDCVRFEIFPPGHLYSSAAGAGFRRWYTPHWFQEQVPRTPYQPLVLREAFEKAVIKRLMTDVPFGVLLSGGLDSSLVASVTKRHLVKTDAAEKFGTELHSFVVGLEGSPDLKAAREVADYLGTTHHEFHFTVQDGIDAIEEVIYHDETYDVTTIRASTPMFLMARKIKSLGVKMVLSGEGSDELLGGYLYFHFAPNREELHRETCRKVKALHQYDCLRANKATSAWGLEVRVPFLDKEFVDVAMGMDPEWKMYDKNLGRIEKWVLRKAFDDEEHPYLPEHILYRQKEQFSDGVGYNWIDGLKAFTEQQVTDEMMNSAAQMFPYNTPVNKEAYYYRMIFERLFPQDSARETVPWGPSIACSTPAAIEWVEQWKASNDPSGRFISSHDSAATDRTXTSWRWSTATGTXANGTVNGNDVAVAIAV

SEQ ID NO: 9677 - protein, 244 aa, Liquidambar styraciflua
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 9678 - protein, 371 aa, Triticum aestivum
AYLGDTIEQVCTKKQAGTGPEFPGYRRPTRPRTRGRTRGCAVDFCHSRGVYHRDLKPENLLLDENSNLKVSDFGLSTISECRRLDGLLHTSCGTPAYVAPEVINRKGYDGAKADIWSCGVILFVLLAGYLPFQDKNLMNMYKKIGKAEFKCPSWFSSDIRRLLLRILDPNPSTRISIERIMEHPWFRKGLDAKLLRYNLQAKDAVPAADMTVTSDPLSCSNSATEGKEQGAKKLSNLNAFDIISLSTGLDLSGMFEDNDKKRESKFTSTNSASTIVSKIEDIAKCMRLKLVKKDGGMMRMESFKPGRKGVMSIDAEIFEVTPDFHLVELKKTNGDTIEYQKVLNQEMRPALKDIVWAWQGEQQPPPPQQSC

SEQ ID NO: 9679 - protein, 481 aa, Pediococcus pentosaceus
MTEKHYKMPENFLWGGAVAAHQFEGGWQEGGKGVSIADVMTAGNKDTARKVTDGIKDGEVYPNHWGIDFYHRYPEDIKLFNEMGFKCFRTSIAWTRIFPNGDETEPNEAGLKFYDDMFDELLKYNIQPIITLSHFEMPYHLVKEYGGWTNRKLIDFFVRFAETVMKRYKGKVKYWMTFNEINNQTDWSNPHHLLQDSAIKVKAGTPGMEEMMYQAAHNEMVASAKVVELGHQIDSEYQIGAMIAMCPIYPLTAKPEDIMMAERAMQTRYYFGDVQANGEYPNWLPKYWERQNIHVEISDYDREILKKGAVDYIGFSYYMSFTTKSTDENTDYAYKEARDLVDNPYVQKSDWGWQIDPVGLRYSMNWMQDRWHKPQFIVENGFGAYDQKEADGAVHDDYRIKYFHDHILEMEKAVALDGVNLIGYTPWGCIDLISASTGEMAKRYGFIYVDQDDQGNGSLERSKKDSFDWYKQVIASNGEDL

SEQ ID NO: 9680 - protein, 492 aa, Zea mays
MAMKKNQDSQLVMGRYRLGQLLGSGNFAKVYKAHKVATGEAVAVKVLDKDAVHRSGMAEKVKTEVDVMRRVRHPNVVRLHEMMATRSKIYFVMEYASGGELFARLAQSTRFPEPVARRYFQQLMTAVEFCHSRGVYHRDLKPENLLLDARGDLKVSDFGLSALQDGRGGRQLRGDGLLHTACGTPAYVAPEVLLKTGYDGAKADIWSCGVILFVLLAGYLPFNDTNLILVYRKITQSNYKCPPWFSVEARKLLARLLDPNPRTRITISKVTANPWFQKGLCPLTTDKPLDLWETSEVLGKEKACRCRHHQRDDADADADADDEENTRKRKRSKVTVSSPPTVAVRPSSMNAFDIISRSSGLDLSKMFDEEHRSEARFSSRESTPRVRPRVRPRVRTRNLDIKLNKRGRVEMEGGQYCRRGTLVIEAEIFEVAPSVRVVEMRKIGGDSPEFREFYRQELKPSLGDIVWSWQGSDSPPVPLLPPAPRQATNQRS

SEQ ID NO: 9681 - protein, 258 aa, Synechococcus elongatus
MRIDCLPALQDNYIFLLVDVEQRQAAVVDPAEAEPVLAALQAEGLTLTAILNTHHHGDHVGGNRRLLRQFPEAAVSASAVDRDRIPGQTVLLEAGDRLQICGQTAEVLFVPGHTRGHIAYYFPEVAEGNPRGALFCGDTLFAGGCGRLFEGTPAQMLDSLQQLRSLPDDTAIYCAHEYTLNNLRFALTVEPDNFDLQQRYQAVAIARQQGQATIPSRLDIEKATNPFLRWDQAALQAAVSSQDPVQTLARLRSRKDQF

SEQ ID NO: 9682 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFMDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTKAAKQWGTKLHSFCVGLEGAPDLKAAKEVAEYIGTVHHEFHYTVQDGIDAIEDVIYHIETYDVTTIRASIPMFLMSRKIKSLGVKMVISGEGSDEIFGGYLYFHKAPNKEEFHQETCRKIKALHKYDCLRANKSTFAWGLEARVPFLDKEFIRVAMNIDPECKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSARLTVPGGPSVACSTAKAVEWDAAWSNNLDPSGRAALGVHASAYGNQVKAVEPEKIIPKMEVSPLGVAI

SEQ ID NO: 9683 - protein, 480 aa, Saccharomyces kluyveri
MEQVDLVQANILASGANKKTVRVVNGLGSLMGSKDMVDVDFDKDSNMDYLLRKDQEEKDVYKNKKHISEQPWTINNWHQHLNWLNMVLVVGIPLIGWYFALSGKVPLSKKVLIFSVAYYVLGGVSITAGYHRLWAHRAYSARWPLRMLFALFGAASVEGSVKWWGHSHRIHHRYTDTTRDPYDARRGLWFSHMGWMLLQPNPKYRARADIADLTDDWIVRFQHRHYIPIMALTAFILPALLCHYFFNDFWGGLVYAGIIRVFAIQQATFCINSLAHYLGDQPFDDRRTPRDNWITALVTFGEGYHNFHHEFPTDYRNAIKWYQYDPTKVFIYTSSLLGLAYNLKKFSQNAIQQGLVQQQQKKLDRSRSKLNWGTPLTQLPVWDKEEFMKSLKSNPGLVIVSGIVHDVSGYITEHPGGETLIQAAAGKDATKAFNGGVYLHSNAAHNVLATMRVAVIKDGVDAAAKFAARRGESFSSKKAI

SEQ ID NO: 9684 - protein, 373 aa, Zea mays
MDSSGGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVTRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 9685 - protein, 324 aa, Arabidopsis thaliana
MKNFNLTHRIVMAPMARMRSYGNIPQPHVALYYCQRTTPGGLLISEATGVSETAMAYQNMPGIWRKEQIEAWKPIVDAVHSHGGIFFCQLWHAGRVSHQDCQPNGESPVSSTDKPFADDPSNEFTPPRRLRTDEIPTIINDFRLAARNATEAGFDGVEIHGAHGYLIDQFMKDSVNDRTDSYGGSLENRCRFALQVIEAVSKEIGPDRVGIRLSPFADYMESGDTDPKRLGLYMAKSLNRFEILYCHMIEPRMKTVSEIFECRESLTPMRNAFNGTFIVAGGYTREDGNKAVAEGRTDLVAYGRLFLANPDLPKRFELNAPLNK

SEQ ID NO: 9686 - protein, 283 aa, Gloeobacter violaceus
MTANVVSGAGGVAGWRALNWPTLGFLVLMHGLALLAPWFFNWQALAVALGLHWLIGSLGICLGYHRLLTHRSFRVPRGLECVFAMLGALALQGGPIFWVAAHRLHHAHADDDARDPHSSGRGFWWSHVLWLLYRHPELSDGQTHRKYAPDLARQPFYRWLNRYHLLLQIPLAVLLFALGGWPFVVYGVFVRAVVLWHTTWLINSAAHLAGYRTSEVPDSSRNLWWAALLTYGEGWHNNHHAQPNAARAGLRWWEVDMTWWVIRALEMAGLATQVVPPRPNPVR

SEQ ID NO: 9687 - protein, 507 aa, Xanthomonas campestris
MRPGHLMVLALLAPTLIAPPVFAQSVLTRDNGAKVGDNQNSQTAGATGPTLLQDVQLIQKLQRFDRERIPERVVHARGTGVKGEFTATADLSSLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPEATRTLTLLYSNEGTPAGYRFMDGNGVHAYKLVNAQGEVHYVKFHWKTLQGIKNLDPKQVAAVQAKDYSHLTNDLVAAIKKGDYPKWDLYVQVLKPEDLAKFDFDPLDATKIWPDVPEQKVGQMVLNKNVDNFFQETEQVAMAPANLVPGIEPSEDRLLQGRIFSYADTQLYRIGANGLSLPVNRPRVAVNNGNQDGQGNIGQTTSGVNYEPSRLEPRPQDTAARYSELPLSGTTQQAKITREQNFKQAGELYRSYSKKDRADLVQSFGESLATTDPESKHLMLSFLYKADPEYGTGVTRVAKGDLARVKQLASSLQD

SEQ ID NO: 9688 - protein, 498 aa, Triticum aestivum
KKNILIEKLHIDISPSLAPWRLVPVSGIENICSSSIDNLGLESSKDEESSNALLSRAWSPGWRNAEKTLEDFVSHGLLDYSKDRMKVAGTTTSLLSPYLHYGEVSVRKIYQLVRVQQIKWENEGKSGAGESVNLFLLSIGLREYSRYLCFNFPFTHERSLLGNLKHYPWRADEDRFKSWRQGMTGYPLVDAGMRELWATGWTHNRIRVIVSSFAVKFLQIPWTWGMKYFWDVLLDADIESDILGWQYISGSLPDGHELGRLDNPEVQGQKYDPDGEYVRTWIPELARMPGEWIHHPWDAPSSILEVAGVELGFNYPMPIVELHTARECLDDAISTMWQLDTAEKLAELDGEVVEDNLSHIKSFDVPKVVLKELSPHCDREVPTDDGRNLELQPKELKGTNKQTICVDVIKASKMEDTGSIANSPISRKRSSSGSVFNVPSYSSSVEVHSQNQHPGGYLVGSSKYILQKAERNCVGKAEDDDSADSGTNTSRASKRPAA

SEQ ID NO: 9689 - protein, 719 aa, Oryza sativa
  misc_feature (505)..(505): Xaa can be any naturally occurring amino acid
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEXAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSLTTGWEVEN

SEQ ID NO: 9690 - protein, 407 aa, Debaryomyces hansenii
MTKSFNYQLSTEFKPKSLADTSLFKPIKVGNMNLQHRAVLAPLTRFRNHINSIPNPEAMGMYYGQRSSRPGTLVITEATIVSAAAGGYDTAPGIYNQEQIDAWSKIFKRVHDNNSYVYLQLWSLGRQSDPANLKKIGKPFVSASDVYSDDRGITSEGVIAEDGAIAVNNELRPMTIPEIKQYVNDYAQAARNSLAAGADGVEVHCGNSYMLNQFLDISSNLRTDEYGSQTLENRARFALECIDAVVEAVGADKVGVRFAPYGRFGGMSGSDDLTAIALYAYIFAELEKRAQQGKRVSYIHLVQARMTDFNINENDESAKFDTEFVYKIWKGVVMKAGAYATDPAAVRREVEVGQTLIAYGRYFISNPDLPDRLALGKPLTKYVRDSFYLPDPIAGYVDYPTYKQQDL

SEQ ID NO: 9691 - protein, 432 aa, Zea mays
  misc_feature (22)..(22): Xaa can be any naturally occurring amino acid
  misc_feature (35)..(35): Xaa can be any naturally occurring amino acid
MGSKKRSPQHPASPAGGEVGAXGGGEGHAGDGGAXTAPVAVVPKPPDVAPFLTKVYDMVSDPATDAVISWSAGGGSFVIWDSHVFERDLLPRHFKHNHFTSFIRQLNTYVRITPSLMLYWMKLLLIVCMKLYACTEIVTYDRWEWANEGFIKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMTSNNVNTFDSTGNDFTDTSALCEWDDMDIFGDELEHILQQPEQDFQVDPPLTVEDYGYDHPRLEQDYQMEAQQNCKNPQYADVITEA

SEQ ID NO: 9692 - protein, 651 aa, Crocosphaera watsonii
MNDNATAKNPFLEEFDYYLFGQGDHHRIYEKMGAHLVEVDGVSGVYFATWAPNAHEVAVVGNFNNWNHEANKMRRTEVGIWELFIPGMNVGDLYKYSVKNHHHYCVYKTDPYGYQQEIRPATASVVADLSTYTWKDQEWIDKRERSNPEKQPMSVYEVHLGSWLHTSIDNPPKEGTSLAVEQKPGARYLNYRELADQLISYVKDMGYTHIELLPVTEYPFDGSWGYQVVGFYAPTSRYGPPEDFMYFVDKCHQEGIGVLLDWVPGHFPKDEHGLAYFDGGPLYEYEDSRKGEIKTWGTLVFDYGRNEVRNFLIASALFWFDKYHIDGIRVDAVAYMIELDKGREGDWIPNQYGDNGHLEAISFLQHLNNTIAHNYPGVVTIAEDSTAWGNVSRPASEGGLGFTFKWNMGWMNDTLKYLKEHPNHRSNCHNKLTFSIWYAFDEKFMLALSHDEVVHLKGHLVNKMPGDEWQKMANVRTLLTYMFAHPGKKTLFMGMEFGQTSEWQEFLDLDWYLLQYEPHKGLKRLVQDLNKMYIREPALYMEDFSYEGFEWIEANDAPRGLISFVRKDPASGDMIVAVCNFKPYVYENYWVGLHYPGEYVELINSDSQVYWGSGVCNPSVIHTREWHDAPWSHALEITVPPLGAVLYKLKR

SEQ ID NO: 9693 - protein, 338 aa, Bacillus subtilis
MARKLFTPITIKDMTLKNRIVMSPMCMYSSHEKDGKLTPFHMAHYISRAIGQVGLIIVEASAVNPQGRITDQDLGIWSDEHIEGFAKLTEQVKEQGSKIGIQLAHAGRKAELEGDIFAPSAIAFDEQSATPVEMSAEKVKETVQEFKQAAARAKEAGFDVIEIHAAHGYLIHEFLSPLSNHRTDEYGGSPENRYRFLREIIDEVKQVWDGPLFVRVSASDYTDKGLDIADHIGFAKWMKEQGVDLIDCSSGALVHADINVFPGYQVSFAEKIREQADMATGAVGMITDGSMAEEILQNGRADLIFIGRELLRDPFFARTAAKQLNTEIPAPVQYERGW

SEQ ID NO: 9694 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQKGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKQSYYWYRNVVSNNWLETRR

SEQ ID NO: 9695 - protein, 221 aa, Brassica napus
MPAHPQSLIYSFVARGTVILVEFTDFKGNFTSVAAQCLQKLPSSNNKFTYNCDGHTFNYLVEDGFTYCVVAVESAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 9696 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDADLPVDTWRVMMYSEILDFHQTVGVANETEGSEQPDSQVEQNNLDSANGA

SEQ ID NO: 9697 - protein, 482 aa, Bordetella pertussis
MNAMTNKTLTTAAGAPVADNNNTMTAGPRGPALLQDVWFLEKLAHFDRERIPERVVHAKGSGAYGTFTVTHDISRYTRARIFAEVGKQTPLFLRFSTVAGERGAADAERDVRGFAIKFYTDEGNWDLVGNNTPVFFIRDPLKFPDFIHTQKRDPKTNLRNATAAWDFWSLNPESLHQVTILMSDRGLPQNYRQQHGFGSHTYSFVNDAGERFYVKFHFKSQQGIACYTDGEAAELVGRDRESAQRDLFQNIEQGQFPRWTLKVQVMPEAEAATYHINPFDLTKVWPHADYPLIEVGVLELNKNPENYFAEVEQAAFTPANVVPGIGFSPDKMLQGRLFSYGDTHRYRLGINHHQIPVNAPRCPFHSFHRDGMGRVDGNGGATLNYEPNSFGEWREAKHAAEPPLALDGQAADRWNHRVDEDYYSQPGALFRLMNDDQKQQLFGNIGRHMAGVPEEIQRRQLEHFRRADPAYAAGVAKALGLK

SEQ ID NO: 9698 - protein, 177 aa, Brassica napus
MSCPVTVSATGLGRSIPSPMTVNPLPLVSMVYHASESAANNPGLSTVRDEATKGYIMQQTMFRVKDPKASLDFYSRVLGMSLLKRLDFSEMKFSLYFLGYEDTSTAPADPTERTVWTFGRPATIELTHNWGTESDPEFKGYHNGNSEPRGFGHIGVTVDDVHKACERFEQLGVEFVK

SEQ ID NO: 9699 - protein, 312 aa, Triticum aestivum
  misc_feature (116)..(116): Xaa can be any naturally occurring amino acid
MAESFVLSTGSRIPSVGLGVWQIQPDAANDAIYAAVKAGYRHIDCAAAYNNEEEVGLALKKLFEDGVVKRDDLFITSKLWAANHAPEDVEEGIDTTLQDLQLDYLDLYLIHGPIRXKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEI

SEQ ID NO: 9700 - protein, 434 aa, Triticum aestivum
VTILNKFVQKSRLVPVRNSRDIVDPRIREHVASALGADTNAVRRKNLHSVESLTKFYGDAAGDAPTYSLIDIFDKLASSPEYRSRAEAVERFNGGSRWKKRGISCVPITYEVALRPTPGKVSILNDGSIAVEVGGVELGQGLYTKVKQMTAFGLRELCPDADGLLDKVRVIQADTLSLIQGSFTGGSTTSESSCEAVRQSCTVLFERLKPIKDSLEAGPGAAAPWSALIAQAKMASVNLSAHAYWKPGPAFRKIHPPTGAAVSEVEIDVLTGATTIMRSDLVYDCGQSLNPAVDLGQVEGAFVQGVGFFTNEDYATNADGLVVNDGTWTYKIPTVDTIPKQFNVELISSARDKKRVLSSKASGEPPLLLAASVHCAMREAIRAARTDFSVNSPLTFQMDVPATMADVKELCGLDVVERHLQSLSSAAEVPTPVA

SEQ ID NO: 9701 - protein, 243 aa, Prunus persica
MAYENKSMSLDSPQRKLGRGKIEIKRIENTTNRQVTFCKRRNGLLKKAYELSVLCDAEVALIVFSNRGRLYEYANNSVKETIERYKKACAESTNTGSVSEASTQYYQQEAAKLRAQTGNLQNSSRHMMGESLSSMNMKDLKNLESKLEKGINRIRSKKNELLFAEIEYMQKREIDLHNNNQLLRAKIAENERSQQNINVMAGGGSYEIMQSQPYDSRNYFQVNALQPNHQYNSRQDPMALQLV

SEQ ID NO: 9702 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHVFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 9703 - protein, 255 aa, Prunus persica
MGRGSVQLKRIENKINRQVTFSKRRSGLLKKAQEISVLCDAEVALIVFSTKGKLFEYSTDSCMERILERYERYSYSEKQLLANDHESTGSWTLEHAKLKARVEVLQRNCSHFMGEDLQSLSLKELQNLEQQLDSALKHIRSRKNQVMYESISELQKKDKALQEQNNLLAKKVKEKEKALAPQAESWEQQVQNQGLDCSSTLLPEALQSLNFGSGSNYQGIRNDGSGGDHEDENETPTANRPNTLLPPWMLRHLNE

SEQ ID NO: 9704 - protein, 596 aa, Sorghum bicolor
MAEGEERPSGGGDDENGEERPSGGGDDENGKYPIGFRFEPTTEELVEFYLLPRLLGEPTVPNEFVIEADAYGCDPEILTEKYKESGVDDTWYFLSPRYRKYRGGDRPVRRTADDRGRWKPSTGQSKPPEDEDDDDASTSRHSKAKKKQAAFSENTLAYYVGSTKDETKTKWLMHELVVPVTPDNGFHSKSKSAAAEPRNDMLVSSRRARRSNSAVFECLRWWIYKSPLRKWKEIDEAAAAAEVPTSSHSSWPAPECVIGEAAARATSSRQQPPAKRPAVGRPAAASGHTGAPNKGVSVSQSTLFPGGCSAPPTRGNGRGSSVRMPPIVVGAGAAGHHGPGLPALMHLLRPPVQVQQTPLVYGYGNRAAGMPNVNGQAAPRWQGPPPHRAAATTPNSLGPEMMTRPPNLAAGQPAWLPSPRRQQQQQQQQQQQQQQPPPETEEAYRNRVYARLIAEMKLQKKAEQDSAARAGQQQISQTASASAKPACFHDEGGDRPAGVEAMVRPAQFPAPHGGYPYGSSSSSNNLAQRPQRQQSTSSAALAPALAAVEKAPAAENVPSNQPVPPAPGANEGSCKGDAPTATIADNIILQILTTDC

SEQ ID NO: 9705 - protein, 159 aa, Triticum aestivum
MAGMVFGLETPMMTALQHLLDIPDGEAGAAAGEKQGPTRAYVRDARAMAATPADVKELPGAYAFVVDMPGLGSGDIKVQVEDERVLVISGERRREEKEDAKYLRMERRMGKLMRKFVLPENADMEKISAACRDGVLTVTVDKLPPPEPKKPKTIQVQVA

SEQ ID NO: 9706 - protein, 353 aa, Actinobacillus pleuropneumoniae
MAKFRYLQTPFKLKNLELKNRIVMPPMCQYSATDGVPNDWHFVHYTARAIGGVGLIIVEMTNVAPNGRITPKCLGLWNDEQRDAFKPIVDSVHKYGSKIVVQIGHAGRKAQDCDDVVAPSAIHYGELDYAGQNLKTPRELSKAEIQEVIQSYQDAVKRAVEAGFDAIEIHGAHGYLIHQFSSPKSNQRSDEYGQDRFLFGEQVIKAAKAVMPADMPLIVRISAQEFGANGFDADYGVEMARRFAAAGADCMHVSAGGDGVLAEGKHPPFNAGYQVYLARAVKQATGLPTIAVGMLDDANVVDHVLSIGDADLVAVGRALLRDPQWVLNVQYAQNATNSSGVEFVPAQYQRGYF

SEQ ID NO: 9707 - protein, 482 aa, Zea mays
MAASVTVENLNPKVLKCEYAVRGEIVIHAQRLQQQLQTQPGSLPFDEILYCNIGNPQSLGQQPVTFFREVLALCDYPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKMQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSTPVREQIYKIASVNLCSNITGQILASLVMNPPKVGDESYASYKAEKDGILESLARRAKALEDAFNKLEGFSCNKAEGAMYLFPQIHLPQKAIEAAKAAKKAPDAFYALRLLESTGIVVVPGSGFRQVPGTWHIRCTILPQEDKIPAVISRFRAFHEAFLAEYRD

SEQ ID NO: 9708 - protein, 275 aa, Salmonella typhimurium
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVTPVINQIELHPLMQQRQLHAWNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQFGG

SEQ ID NO: 9709 - protein, 721 aa, Novosphingobium aromaticivorans
MKPPASAIDALLDGTHADPFSLLGIHEGPDGAFARAVLPGAEEAVAWSLSGKKLGKLSRVDGRGLFEGKVKGPRQPVRYACKADGHEWLVTDPYSFGPVLGPLDDFLIAEGTHLRLFDKMGAHLIEHEGARGVHFAVWAPNARLVSVVGDFNDWDHRRHPMRRRADIGVWEIFIPDIGEHRAYKYRIVGHDGGVLPLKADPYALAAEFRPSTASLTAHPVKMDWADAAHRAHWASVDARREPMSIYEVHPGSWQKPHEEGFHTWDELADRLIPYVAEMGFTHIEFLPVSEHPYDPSWGYQTTGLYAPSARFGPPEGFARFVDGAHRAGISVLIDWVPAHFPTDEHGLVRFDGTALYEHEDPRLGFHPDWNTLIYNFGRREVVSFLVNNALFWAERYHVDGLRVDAVASMLYRDYSRKAGEWIPNAEGGRENWEAVEFLKAMNRAVYGSHAGFLTIAEESTAWPGVSKPAFDGAPRENLGFGFKWNMGFMHDTLKYMAREPIHRRYHHDEITFGLMYAFSENFVLPLSHDEVVHGKGSLLNKMSGDDWQKFANLRAYYGLMWGYPGKKLLFMGQEFAQRREWSEARALDWDLLQAPAHEGIRRWVRDLNRVYASRPALHARDCEPEGFEWLVVDDAEASIFAWLRKAPGARPVAVICNMTPQVHDHYRLPLPLDGEWREVLNSDAEDYGGSGIGNLGKVTAEQGAAFVVLPPLATLMLEFEG

SEQ ID NO: 9710 - protein, 468 aa, Zea mays
MFHHQQELLQAEAAAADRESSMSNLTSSTFGGPNAAPAAAAAAPPAPAASGNNKRKRSLPGNPDPEAEVVALSPATLMATNRFVCEICGKGFQRDQNLQLHRRGHNLPWKLKQRGTGKEAQRRKVYVCPEASCVHHDPARALGDLTGIKKHFFRKHGEKKWKCDKCSKKYAVHSDWKAHSKICGTREYKCDCGTIFSRRDSFITHRAFCDALTEESAKAIGLNAMAAVPAQHHHHPMLFSPPPTHVMQQDVALLQEHHHQEVMQQEHCNYAMKTEMPPWPGMTYDHPLLQPLCNAAAPQSSATSTPPPPTTMQLPAAYAHLSATALLQKAAQMGATVAGAGYTQMAGAATSATFGLGLPDLQNTQQQQHQDGEIMAGLARTASHGRGGEEGGGGGGDGMTRDFLGLRAFSHRDILGLAGLDSSCMGAIISASASMNCYDEPQQRAQAQAEQQQQSSNEQWHSMGSHQS

SEQ ID NO: 9711 - protein, 505 aa, Bifidobacterium longum
MNSRGLKQVDLVHAAEHRGVKMGKSHISQYVAGKTMPREDVLEFLASELDVDTNWLRGEESTTQLNSDASNSVTDGEHAATPLAMGAAKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 9712 - protein, 111 aa, Taraxacum officinale
KKRGHAHGNRSWIKIEENGNSKVVELDKASVMRQCCLPARDLRLLDPLFIYPSTILGREKAIVVSLEQIRCIITADEVFLMNSLDASVVQYKSELCKRLQEEKCHSDDLPF

SEQ ID NO: 9713 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSI

SEQ ID NO: 9714 - protein, 333 aa, Cryptococcus neoformans
MAPASHFTLNNGKKIPSIGLGTWQSEPGQVAKAVESALKSGYRHIDCAWAYGNEKEVGEGLKASGVPREEIHITSKLFELHHHPEHVELACKDTLKNLGVEYLDLYLLHWNINFQVDAPKGTVPTFDHAVKADNGKIKLDVALADNVMPTWREMEKLVEKGLVKSIGISNFNIHRTEKLLKEAKIKPVADQVELSIQCPQHELVAYLKSKDILPQGYSPLGGTGKSNLRENDVVQKIADKYKVQTANILLSWLVMRGINPVPKSVTPERIANNLKLVDLSQEDFKELEKLAESHPPKRVCDQSEDFEPKYDIFQENDPEFSDKAQFAKLGLKL

SEQ ID NO: 9715 - protein, 494 aa, Arabidopsis thaliana
MDGSSEKTTNKLVSILPNYRIGKTLGHGSFAKVKLALHVATGHKVAIKILNRSKIKNMGIEIKVQREIKILRFLMHPHIIRQYEVIETPNDIYVVMEYVKSGELFDYIVEKGKLQEDEARHLFQQIISGVEYCHRNMIVHRDLKPENVLLDSQCNIKIVDFGLSNVMHDGHFLKTSCGSPNYAAPEVISGKPYGPDVDIWSCGVILYALLCGTLPFDDENIPNVFEKIKRGMYTLPNHLSHFARDLIPRMLMVDPTMRISITEIRQHPWFNNHLPLYLSIPPLDTIDQAKKIEEEIIQNVVNIGFDRNHVVDSLANRIQNEATVAYHLILDNRNQNSVPNDPFQSKFKEISDGIFNSTLPVQNITSHVGHSFSALYGLKSNVKDDKTWTLGLQSQGSPYDIMTEIFKALQNLKICWKKIGLYNIKCRWVRSFAYYKNHTIEDECAIILPTVIKFEIQLYKVREGKYLLDILRIDGPQFIFFDLCVAFLRELGVL

SEQ ID NO: 9716 - protein, 264 aa, Haloarcula marismortui
MVGVGTWDIDGDTVQKSVRAGLNVGYAHVDTAEGYKNESEIGEALADYDREDVFLTSKVLPKHLDYESVIEACEASLDRLGTDYLDLYLVHWPNPATSIRETMNAMATLHDQGKIRNVGVSNFSAYQLGAAQHVADVPIAVNQIEYHPWNTQDQVVEFCRDTDTVVEAAAPLGRTKVFADDIIQDLSEKYDRSPAQIVLKWAVENNVVVLPKSSSPEHVRQNFDLFDWELDATDRERIDAIEREQAVYDTGINDWDNDTYGISQ

SEQ ID NO: 9717 - protein, 460 aa, Salmonella enterica
MRYRFPDNFWWGSACSALQTEGDSLNGGKSQTTWDVWFERQPDRFHQGIGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGVVLNLTPSYPRSQHPADVQAAHHADLLFNRSFLDPVLKGEYPAELVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 9718 - protein, 1462 aa, Candida albicans
MSTVVNRRSSHQFDSPSNHLDHSSSMNVDKVVQSVTNATKRLSQISTNTNNSNKKRKTQNKIGPWKLGRTLGRGSTGRVRLAKNTTTGQLAAVKIVPKSNFKKLENPKYKRSKEDATRLPYGIEREIIIMKLISHPNIMGLYDVWENKNDLYLILEYIEGGELFDYLIKRGKLQEYEAINYFKQIINGINYLHQFNICHRDLKPENLLLDFNKNIKIADFGMAALEVKEKLLETSCGSPHYASPEIVAGKNYHGAPSDIWSCGIILFALLTGHLPFDDENIRKLLLKVQSGKFNMPPELSFEAKDLITKMLKVNPRERITIDAILTHPLLAKYPEPTVSYSSTTTLDINSINIKQIESVDKIDKEILKNLSVLFHNCDEKTIISRLLSPNRCPEKMFYYLLMKYRNEHLSNSNSFNSSNDVDSARSLPRSTSYVKTTVTDHATGEKHTTVKKIQQSSSIYSNRSLLKKSTSAKGNVLSNITNRPNTPKQFSASSSFNKKKALHSKTQIYASRSRNASSRSLKSNSSTGRNGNNASVTSVNKIPEITGATVLQPIPSMAMNRGDEQQNKTKKNLTGTFGNKSLLNFQLICEEVFENDKENSKPVSKTPVSQLPPPPPPPIETPTSRTNSVKRGKTWSLARRERELAEQVRQRNEARENKLKAEELARKELEQEKKRIAEEKKRLEQQERELDEKQKLQEKQKAALEKLQKHQSAHDFEGLFASNRRSVTDMAPSSGMSSLDPRAHMVSRANTIGSPNLSSSSVNIDENASKVLHKFGIDVAPSPKRFSRASKTSTSKNLSSFLAPTVSRNLSSQLKTSSSKNLAGYLHGTTDTNGSAIAAKKKDDSTNEALTIEEFNAKERTSMSPSISKASVNKRNSNQSSYYRSMFSDNGNDDNVTKVRTGESHLSVQEEEEMDMENAIDEDISLIPNPRFSRFSFGGLLGSNTVANEEGDWTIMNSTLNHSNTVVRGTHNKSSTMLGLGIKMRDTTTIKEDEEFEDEKPFISVPSSEDDEGNTHKNKRGGLRDSGNYDFDEEHSVASTANTEYSDVASQGQQMPGSHTIHQLETELSNFDLLSYRVADIGKVNKHKPSIVDSKETLLKNHSSDEATIEVKEDNNEHDFNDKIKQHYDDNGDSEEDDEDEDEEEEDDDDDDDARSSFEARPHSHNYSLAEITSESPVGGGYESPSIANDFKKSRHSTGIFSTTQFPRSPYVVNNNGDSNKDENSQQQTKHMLNDGHKGLITSPVQDTFGSKKPVESNSLFRRLSLNPNRAAPKAPAPPPPSAPISSAAKANISQPLSSPTKGHNRFSRISIGSKNMLQKEDKSTKSNWFKKFFHSLTTPSAKDQSGNSSSKVASKDIKIIDTSLTAAQLIRVIKYQLELKKIEGSISKVDIDEEFGLISGVIPSKFANGRKLKFKIEVIDLINSSSLHVIKMKGNDKGFQSLVNIVTFIIKKEEQDKISRR

SEQ ID NO: 9719 - protein, 1084 aa, Pseudomonas aeruginosa
MKSASALEHDNKLLLKWTTLSQSLSIGLICVVVLTVLLFSICYWSLGRLFQEEEDKVSFHFTRMMDVIREHEVFLGRIARKSDKTTQKYDYDVVPLQRHLLAKENGLAVYEGREFSFAMPFLLATKHALSADSSGDPFSLGVLLANFYGSFWSVSAYPAPQLLIFDLSGSTRLAVPSIPSTAQRDRLSGSYPMIVERILARLRTRPVGEDAQRVHWIRADRYRDSALEMLGVARVDLPETLWWHDEPNHLIIAASLLDLRRINDFEQLVERPAFDSYSLVSPDGEVLLGAAPATGLRDGLNLTRQGVAVQLLSQPENGWLAVYRTDYGNFFRHSRWLVAGLLLTPALLLAGWLGMRWYTSSVVNPVHRAHRQLVESDTFSRTLIQTAPVALVVLTQDDQQLVTCNHLAAQWLGGPTEILGLTSNWKLFDARGQVPGDICIQVGGRYLQTAFAATRYAGTEAVLCVFNDITVHCEAETALSNAKRAADAASQAKTLFLARMSHEIRTPLYGVLGTLELLDLTTLNERQRAYLRTIQSSSATLMQLISDVLDVSKIEAGQMALTLAAFNPLDLVREVLGNFAASAMAKDLQFYACIDTEVPAQLIGDVTRIRQVLNNLVNNALKFTDIGRVVLRVKLLSRNDGRALLQWQVADTGIGIAHEQQERLFEAFYQVSGAHHAGGTGLGLSICWHLAEMMGGHLRMVSETGLGSSFSLVLELPEDEQSGLACRPGLLKSACVHVRSPVRELADSVGAWLKAWGCKVSSGEAAPSELETCVLLELLPMAAGPASSPWPGPRVRASMDAPCQPELREDGWRVGLHNLAGIGQALAQALGGDIPEQTPANACARSGRLDLEVLVAEDNPVNQALLREQLEELGCRVSLAGDGRQALQLFDSGRFDLLLSDVNMPNMTGYELTQALRERGETLPIIGVTANALREEGERCRAVGMNSWLVKPITLHTLHELLSEFARAGVVLPAQARDLGPPAQLDDGLSPQVPERMRALFLETMGKDLEAARQAIRRNDPKGLQQDLHRMAGSLAVMRARTLVVMCQGAEEGLLESRLECSAVEIGEVLVHIEQALEFVRKTG

SEQ ID NO: 9720 - protein, 516 aa, Lotus corniculatus
MDGPVGRGGGAGLDIYLPNYKLGKTLGIGSFGKVKIAEHVLTGHKVAIKILNRRKIKNMEMEEKVRREIKILRLFMHPHIIRLYEVIETPTDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRMTIPEIRQHPWFQARLPRYLAVPPPDTMQQAKKIDEEVVQEVVNMGFDRNQLIESLRNRIQNEGTVAYYLLLDNRFRVSSGYLGAEFQETMDSGFNQMHPGEVASSVVGHRIPGYIDYPGVGMRPQFPVERKWALGLQSRAHPREIMTEVLKALQELNVCWKKIGHYNMKCRWVAGIPGHHEGMVNNNTAHSNHYFGDDSSIIENDAVPSSNVVKFEVQLYKTREEKYLLDLQRVQGAQFLFLDLCAAFLAQLRVL

SEQ ID NO: 9721 - protein, 365 aa, Pseudomonas putida
MKLLQPLQIGPLTLPNRVFMAPLTRLRSLEPGDVPTALMAEYYRQRASAGLIITEATQISFQAKGYSGSPGIHSAEQIAAWKHINEGIHAEGGHSAVQVWHTGRVSHTSLQPGGKAPVAPSALPADARTTLRDAQGNLTRVETSAPRALSEAEIAGIVADFGQAAINACEAGFDFIELHAAHGYLLHQFLTPSANQREDRYGGSVENRARIVLEAVDAAIANWSADRVGIRVFPLGGFNGVDNGEDQEAAGLYLIRELAKRNLAYLHLSEPDWAGGKPLRDEFRQAIRAAYPGVIIAAGAYTAEKGEDLIGRGLIDAVAFGRAYIANPDLVERLRLQAPLNEHRAKFDYANGPEGYTDYPFLKQA

SEQ ID NO: 9722 - protein, 339 aa, Bordetella pertussis
MKRKTLTQYLVEQQRSAQALGPEVRLLIEVVARACKAISHAVSKGALGGVLGSLESENVQGEVQKKLDVLSNEILLEANEWGGHLAAMASEEMETIHLIPNRYPKGEYLLLFDPLDGSSNIDVNVSIGTIFSVLRAPHRVAGADVCEQDFLQPGSQQVAAGYAVYGPQTMLVLTIGNGVVGFTLDREMGSWVLTHESMRIPEDTKEFAINMSNMRHWAPPVKRYIDECLAGKTGPLGKDYNMRWIASMVADVHRILTRGGIFMYPWDAREPGKAGKLRLMYEANPMGLIVEQAGGAAIDGTGRILDIQPDKLHQRVSVILGSKNEVERVGRYHAEAHAS

SEQ ID NO: 9723 - protein, 492 aa, Raphanus sativus
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDKFDFDPLDVTKTWPEDLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPSI

SEQ ID NO: 9724 - protein, 441 aa, Lotus corniculatus
MNQPKIKRRVGKYEVGRTIGEGTFAKVKFARNSETGEAVALKILDKEKVLKHKMAEQIKREVATMKLIKHPNVVQLYEVLGSKTKIYMVLEFVTGGELFDKIVNHGRMCEDEARRYFQQLINTVDYCHSRGVYHRDLKPENLLLDACGNLKVSDFGLSALSQQIKDDGLLHTTCGTPNYVAPEVLNDKGYDGATADLWSCGVILFVLVAGYLPFDDPNLMELYKKISAAEFTCPPWLSFSARKLITRILDPNPMTRITIAEILEDEWFKKDYKPPIFQENGETNLDDVEAVFKDSEEHHVTEKKEEQPTAMNAFELISMSKGLNLENLFDVEQGFKRETRFTSKSPANEIISKIEEAAKPLGFDVQKKNYKMRLANVKAGRKGNLNVATEVFQVAPSLHMVEVRKAKGDTLEFHKFYKKLSTCLEDVVWKTEDDMQKQEAK

SEQ ID NO: 9725 - protein, 401 aa, Unknown
  Shewanella sp. ANA-3
MKQLIRNIVCLGLGLSLGLSISLSSQENAKSYQSDFDYPLLQDVLETVETYYVKTVSKDELVQAAIKGIFEHLDPYSSFLNHQELLDLKDSNRGEYFGFGFEVASDKDHISIIAPFANSPAEQAGIQAGDIIIKLNDTPTTETNLADILNQIKQHSLSNQSIHLTLKHHNDDAQFEVSLKPSTITIQSVTSKLLDGNIGYVRLSSFQENSTEDMVRSLSQWQNAHLTGLILDLRNNPGGLLDQAIKIADLFLAKGRIVSTSGRFFDANSDYYASPQTMLTNVPMLVLINKGSASASEVLAAALQENGRAKLLGETSFGKGTVQSLIPILNDGNAIKLTIAQYNTPRGENIHDIGIVPDIKVATETGSNQKNMAIIDAISARTDVSQDSLVTSAIAWMQHHD

SEQ ID NO: 9726 - protein, 194 aa, Brassica napus
  misc_feature (142)..(142): Xaa can be any naturally occurring amino acid
NISGVRQRHWGSGVADIRRPHWKRRIWLGTFETAEEAARAYDEAAVLMSGRNAKTNFSLNNNNNTGDTSEGKTDISSSSSSSSSLSTILSAKLRKCCKSPSPSLTCLRLDTGSSHIRSLAEIVPGCRSASSRVLTGELRPAXSQEPTSTTASKDDVVGPATEVGGGGEEGLMDEEEKVALQMIEELLIYSYFYC

SEQ ID NO: 9727 - protein, 736 aa, Sinorhizobium meliloti
MTVPPGKDPAPAPPGMLPAPEIAAILSGTHSNPFAVLGVHAAGKTYVARCFVPGAETVIAETLSGKELGTLERRDEAGFFEGPVALRKEQPIRYRARNDGGEWTVIDPYSFGPVLGPMDDYYIREGSHLRLFDKMGAHPIRHDGAEGFHFAVWAPNARRVSVVGSFNDWDGRRHVMRLRVDTGIWEIFIPGVPVGTPYKYEIVDSNGTLLPLKADPFARRSELRPDTASMTADEIAQNWEDEAHRRHWAEIDPRRQPISIYEVHAASWQRRDNGDMLTWDELAERLIPYCVDMGFTHIEFLPISEYPYDPSWGYQTTGLYAPTARFGEPEGFARFVNGCHKVGIGVILDWVPAHFPTDEHGLRWFDGTALYEHADPRQGFHPDWNTAIYNFGRQEVVAFLVNNALYWAEKFHVDGLRVDAVASMLYLDYSRKHGEWVPNEYGGNENLEAVRFLQTMNTRIYGIHQGVLTIAEESTSWPKVSHPVHAGGLGFGFKWNMGFMHDTLQYLSREPVHRKFHHNDMTFGLLYAFSENFVLPLSHDEVVHGKGSLIAKMAGDDWQKFANLRAYYGFMWGYPGKKLLFMGQEFAQWREWSEDRGLDWNLLEYNLHEGMRRLVRDLNGTYRSKPALHARDCEGDGFEWLIADDRENSVFAWLRKAPGEKLVAVVTNFTPVYREHYDIPLPVAGRWKEVLNTDAEIYGGSGKGNGGAVHAEKRANGETIATITLPPLATLMLEQD

SEQ ID NO: 9728 - protein, 251 aa, Vitis vinifera
MDSDHEEFSASSSSSSSRTNPNSSDSLLPLQCIGHKRKAGRKKFRETRHPIYRGVRQRNGNKWVCEVREPLKKSRIWLGTFPTPKMAARAHDVAALALRGRFASLNFPDSAWRLPRPKSSSAEDIQVAALEATKAFNPTAPSSSSLASALDNMSGVADSKKVLETSPNVESPKLKSQRMVLEVSPVDTKRSEKVGDGSTTVSMDEEAMFNMQGLINSMAEGLLLTPPAMCKGFSWDDATDSHIDLSLWNDD

SEQ ID NO: 9729 - protein, 164 aa, Magnetospirillum magnetotacticum
MIPWGRSNGNQVPSVLRDGDRDPFLSLHREVNRLFDDVFRGFGSNLPSLVGASAFSGGWPNVEISDGEKEIKVTAEVPGLEEKDIEVLLDDGVLTLKGEKRSETEDKDRQFSERFYGRFERRIPLGYEVKDDKVDARFRNGVLTVTLPKSEKAQSQVKRIAIKS

SEQ ID NO: 9730 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 9731 - protein, 292 aa, Leuconostoc mesenteroides
MDYKTLASGIEMPLLGFGVFQVQEKGAAKQAVLDAIKTGYRLIDTAASYGNEREVGEAILEAINQGIVKREELFVTSKMWVQDVSAQQATAAIQSSLQRLNLDYLDLYLIHQPYNDVFGAWRAMESAYRSGQLKAIGVSNFDIAQLTNLAEFSDIKPMLNQIEVNPFQQNKKDITYFSQYGVQVEAWAPFAEGKNDLFSNILLRKIADKHHKSIAQIVLRWLTQRNIIVVAKSVKPERMAQNLDIFDFKLTHQELAEIETLDTNSSQFFNHADPDMIKWMANREISYDVTFN

SEQ ID NO: 9732 - protein, 267 aa, Alpinia hainanensis
MEHKADQDRLLGFKGGKLEPPVAAVGRMGRGKIEIKRIENTTSRQVTFCKRRNGLLKKAYELSLLCDAEVALVVFSCRGRLYEYASSSVKSTIEKYKKACKDTTNDGFVSEANAQYYQQEASKLRQQINSIQISNRNLMGESLHSMNLRDLKQLESRLEKGIGKIRNKKNELLFAEIEYMQRREMELQSDNIFLRNKIAETDRVHQQMSMLPSTGATVAYEAMPTYYSGNFMQCKNRSQTNIYPQQRQRTFTSTPMRSKHGAWVLRG

SEQ ID NO: 9733 - protein, 483 aa, Lactobacillus johnsonii
MAEVEPNNSHQNKEISNNKKKHLPKYAQFLLTGIAGAAIGAGLTFGIMEVKELKSPFYQVEKVYEQLQGSYYKKVSPQTLRQGAINGMLNSLNDPFSEGLSGANQEQVNNILEGSSFGGVGIQMAVRNNKVVVDSIVADSPASKSTIKPGDEIVAVNNKKVSAAQFSKVAPLVRGKIGTKVTLKLRRANSTFNVTLKRAKISQSSLTKRTEGNATIITITQFDVNTAKDLKSALKSIDTKKYPKLIIDLQDNPGGAMDAALKSASYFLPNNKIIMQYQDRKQKEVIRSDKKLSGGFHTNLKPIILINANTASASEIFTAALVQNHRAVSVGQTSYGKGTVQEVGQTQDSEYKYTIAKWLTPDGTWINQKGLKPTYPVPESSLAKLPQFQSMSILKKSMTGVDVATLQQYLTALGYMPKHVTGVFNDETKNAVIEFQKAHGLTADGIVNGQVQAQLYLAVAQKLQDDNPALKKAMSLNLKEMED

SEQ ID NO: 9734 - protein, 681 aa, Oryza sativa
MSASPSSMKRRRRRRGGGADGGVVQAGPARGGQPALAAAARAAGEVGAGVRVGAGGGRAVLPGAGVPVVAQPEPQAPGRLAPAARRQQARHPPLRRRRRRAHRARPQHRRHASLLQPPLRPAVAGEGPPGEGAADGRGHRRAVVQRRPAVRAMGGGRRRRLPVHHVRAVLGQVPVHARPGGALLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRDSRATGWLHDRIRVVVSSFFVKVLQLPWRWGMKYFWDTLLDGDLESDRLGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTWERRRRGARLVASGSVRPLRSLRCR

SEQ ID NO: 9735 - protein, 649 aa, Nostoc punctiforme
MCGITGFWDISKQFSGEHLDETIQKMSKTLLHRGPDDGGIWTDVEVGVALGHRRLSIVDLSPLGHQPMMSANGRYMVVFNGEIYNFLELRRELTQLGHNFRGHSDTEIMLAGFSEWGLDKAIRRFNGMFAFALWDRQKRILHLGRDRLGEKPLYYGWQGSTFLFTSELKALKAHPNFRAEINRDALTQFFRYSYLPAPYSIYQGIYKLPPGTLLSWNGIDAHPDPVTYWSAREVTELGIAEPFMGSESEAVIQLEALLREAVGLRMVADVPLGAFISGGIDSSTIVALMQAQSSQPVKTFTIGFNEEAYNEAKHAKAVAKHLGTDHTELYVNPKEALEVIPKLPFLYDEPFSDVSQIPTFLVSQLAKQQVTVSLSGDGGDELFAGYNRYLFGRKIWQAIGWIPTTVRKNSARALTSVSPQNWNRGFANVNALLPSRIKQPEFGNKLHTFSEIMALPNPTAIYTKLVSHWEDPKALVIDGLEPPTILSNSQNWPHLLDFTQCMMYFDTVTYLPDDILVKVDRASMGVSLEGRIPFLDHRLVEFAWRLPLSMKIRNGQGKWLLRQVLYKYVPPTLVERPKVGFGVPINSWLRGPLRDWAEELLNENRLKNEGFFNPKPIREKWEEHLSGAASWEYRLWDVLMFQAWLEANH

SEQ ID NO: 9736 - protein, 797 aa, Arabidopsis thaliana
MNVRDEGKTTAEKHGGGEENKSPENKWRFNSPLAQVSLMGFVCFCCPGMFNALSGMGGGGQVDPTAANNANTAVYTAFTVFGLLGGGFYNVLGPRLTLAAGCSTYVLYAGSFLYYNHHHHQAFAIVAGALLGCGAGLLWAGEGAVMTSYPPPHRKGTYIALFWSIFNLGGVIGGLIPFILNYQRSSAASVNDSTYIAFMCFMFAGVLLSFGILPATSVIRNDGSRCSAVKYSRPSTEAAAVLRLFLDRKMLLIVPAAWASNFFYSYQFNNVNGLLFNLRTRGFNNVFYWGAQMAGSIAIGYVMDFSFKSRRARGFTGISLVAVIGTIIWAGGLANQHGYSLDKLPEKKLDFKDSGIEFAGPFVLYMSYGLLDAMYQSMVYWLIGALADDSQTLSRYSGFYKGVQSAGAAVAWQVDTRKVPLMSQLIVNWSLTTTAHTDSMETKQSIPLLMPYKMGPFNLSHRVVLAPLTRSRSYGNIPQPNAKLYYTQRTTPGGLLISESCVVSETSLGYPDLPGLWNRDQVEAWKPIVDAVHSKGGIFFCQIWHGGRVFHQDQPNGEAPVSSTDKPLMCKNMYGGQFKPPRRLRSDELPAIVNDFRIAARNAIEAGFDGVEVHGAHGYLIDQFLKDKVNDRSDQYGGSLENRCRFALEVIEAVTLAICRLHGVRRLESRSIRALPGASYEQAWHGVVYGHMVEPRMKTLEGIFECTESLTPMRKAFKGTFIVAGGYSREDGNKAVEEGRTDLVAYGRPFLANPDLTRRFELNEPLNRYDRSTFYTSDPVVGYTDYPFLETTDTTTA

SEQ ID NO: 9737 - protein, 448 aa, Lotus corniculatus
MVLRKVGKYEIGRTIGEGTFAKVKFAQNTETGESVAMKVLDRNTIIKHNMVDQIKREISIMKLVRHPYVVRLYEVLASRTKIYIILEFITGGELFDKIIRHGRLSEAESRRYFQQLIDGVDYCHSKGVYHRDLKPENLLLDSLGNIKISDFGLSALPEQGVSILRTTCGTPNYVAPEVLSHKGYNGAVADVWSCGVILYVLLVGYLPFDELDLTSLYSKIEKAEYSCPPGFPVGAKTLIHKILDPNPETRITIEQIRNDEWFQRGYVPVSLLEYEDVNLDDVNAVFDDAEEQRANQQCDHEDMGPLMLNAFDLIILSQGLNLAAIFDRGQDSMKYQTRFITQKPAKVVLSSMEVVAQSMGFKTHIRNYKMRVEGLSAKKTSHFSVMLEIFEVAPTFYMVDIQKAAGDAGEYLKFYKNFCGNLEDIIWKPPHESTKSKVSKTRSKRRSR

SEQ ID NO: 9738 - protein, 671 aa, Streptomyces avermitilis
MSRYPHLLNPLDLGFTSLPNRVLMGSMHVGLEEAERGFERMAEFYAARARGGVGLIVTGGIAPNDAGRPYEGGAKLTTEAEAEQHTAITEAVHREGGKIAMQILHFGRYAYHQDLVAPSALQAPISPFPPHALTDAEIERTIDDYARTARLARQAGYDGVEIMGSEGYLINEFIATQTNRREDRWGGSYENRMRFPVEIVRRVREAVGEDFIIIYRLSMLDLVPGGSSLDEVITLAQAVEAAGATIINTGIGWHEARIPTIATSVPRGAYAWVTKKVMGAVSVPLVTTNRINTPELAEQLLAEGHADMVSMARPMLADPDFVAKAVAGRPEAINTCIGCNQACLDHTFGGKITSCLVNPRACHETELILSPTRLRKRVAVVGAGPAGLACAVSAAERGHDVTLFDAASEIGGQLNVARKVPGKQEFDETLRYFRTQLEQHGVDVRLNTRVTSEQVAAYEEVVVATGVSPRTPEIPGIDHPSVLGYLDVLRDGAPVGDRVAVLGAGGIGFDVAEYLTDSGDKASEDPATYFRSWGVDMDYRAPGGLGAPERPAPPRTVHLLQRKTSKVGAGLGKTTGWIHRTELKHRGVTMVPGVQYDRIDDAGLHITVDGHSQVLEVDTVVLCTGQDPRRDLYQELIAAGHRAHLIGGADVAAELDAKRAIKQGTELAAAL

SEQ ID NO: 9739 - protein, 128 aa, Arabidopsis thaliana
  misc_feature (17)..(17): Xaa can be any naturally occurring amino acid
  misc_feature (101)..(101): Xaa can be any naturally occurring amino acid
  misc_feature (124)..(124): Xaa can be any naturally occurring amino acid
KNIDNFFAENEQLAFCXAIIVPGIHYSDDKLLQTRVFSYADTQRHRLGPNYLQLPVNAPKCAHHNNHHEGFMNFMHRDEEVNYFPSRYDQVRHAEKYPTPXAVCSGKRERCIIEKEEQLQRKPXGDNR

SEQ ID NO: 9740 - protein, 227 aa, Oryza sativa
MGRGKIAIKRIDNTMNRQVTFSKRRGGLMKKARELAILCDADVGLIVFSCTGRLYDFSSSSMKSIIERYQEAGEEHCRLLNPMSEAKFWQREVTTLRQQVQNLHHNNRQLLGEEISNFTVRDLQLLQNQVEMSLHSIRNKKDQLLAEEILKLNEKGSLVQKENSELRKKFNIAHQRNIELHKKLNSGESTSSEQVTRSSKDPGESSTPRDSRVCIDLELSQKEVEDE

SEQ ID NO: 9741 - protein, 132 aa, Glycine max
  misc_feature (30)..(30): Xaa can be any naturally occurring amino acid
  misc_feature (45)..(45): Xaa can be any naturally occurring amino acid
  misc_feature (60)..(60): Xaa can be any naturally occurring amino acid
  misc_feature (85)..(85): Xaa can be any naturally occurring amino acid
  misc_feature (98)..(98): Xaa can be any naturally occurring amino acid
  misc_feature (116)..(116): Xaa can be any naturally occurring amino acid
ENAHVPEKKLHSFKKVSRSMGYGDNDITLXSCSSGSRGYHRACGXTMRYMEVTGLSAEVXREQISIVASVTLCSNISGRILATLXLSPTAAGDELSDXFYTDKDNIFESLARRIHXLRDAFYTIKGGTCNKA

SEQ ID NO: 9742 - protein, 638 aa, Magnetospirillum magnetotacticum
MCGFAGFLDLTQATPDRERVVRAMAATLLHRGPDDDGAWVDDGAGVALGFRRLAIIDLSPQGHQPMTSHDGRWVISFNGEIYNHEALRARLGEDIGWRGHSDTEVLLQAVSAWGMERALAEFDGMFAFALWDRQDRVLTLARDRFGEKPLYWTQSGGHLLFGSEIKALRAHPAWTGGIDRDALALYMRLGWITAPHTIHSGVFKLEPGHVMRVSEGQISTQAYWSAAECAAGVENGFTGNAEAAADRLEELLRQSVRLRMQADVPVGVFLSGGIDSSITAALMRQLSSEPVHSFTIGFDQSGLDESPHARAVADHLGTIHTEVRISDAEALAQVPRLPLLYDEPFADAAALPTALLAQVTRKSVTVALSGDGADELFGGYGIYRSIPKDWGRLRGLPGGLKSLGALGARQLAEPAEGLAALAGRFAKRRSHPGHRLRREAERLEVQSLAGLLGLHYSRWRGMPALVPGAREAQSLFSAPTPALKDDALATMVLDACGYLPDDLCVKTDRATMGASLEARLPFLALEIAQFAWSLPTGLKIEGETGKAVLRRVLYRHVPRALVDRPKMGFEVPLRRWLNGQLRDWADDLLSEDRLRRQGFLDTALVAQCWREHRSGAKNWQNEIWHALMFQAWLDSVNP

SEQ ID NO: 9743 - protein, 426 aa, Lotus corniculatus
GRVLGQGNFAKVYHGRNLATNENVAIKVIKKEKLKKDRLVKQIKREVSVMRLVRHPHIVELKEVMATKGKIFLVMEYVKGGELFTKVNKGKLNEDDARKYFQQLISAVDFCHSRGVTHRDLKPENLLLDENEDLKVSDFGLSALPEQRRDDGMLVTPCGTPAYVAPEVLKKKGYDGSKADIWSCGVILYALLSGYLPFQGENVMRIYRKAFKAEYEFPEWISPQAKNLISNLLVADPEKRYSIPEIISDPWFQYGFMRPLAFSMKESAVGEDSTIDHFGGEEEEVPELVAAMGKPARPFYNAFEIISSLSHGFDLRSLFETRKRSPSMFISKYSASAVVAKLEGMAKKLNFRVTGKKEFTVRMQGMKEGRKGKLAMTMEVFEVAPEVAVVEFSKSAGDTLEYVKFCEEQVRPSLKDIVWSWQGDSN

SEQ ID NO: 9744 - protein, 140 aa, Triticum aestivum
MVSFEMNDLKKIGLGLTGFGIFFSFLGIVFFFDKGLIAMGNILFLSGLGLTIGLKSTMQFFTKPKNYKGTISFGAGFFLVLIGWPFFGMLLEAYGFIVLFSGFWPTLAVFLQRIPIIGWIFQQPFVTSFLDRYRGKRVPV

SEQ ID NO: 9745 - protein, 508 aa, Haemophilus influenzae
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTDAEAAEIIANDRESHQRDLYEAIERGDFPKWTLFVQIMPEADAEKVPYHPFDLTKVWSKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNAEQKQSLFNNTAAAMGDAPDFIKYRHIRNCHWCDAAYGEGVAKALGLTVEDALKARDTDPALGQGGLL

SEQ ID NO: 9746 - protein, 274 aa, Saccharomyces cerevisiae
MQVKSIKMRWESGGVNYCYLLSDSKNKKSWLIDPAEPPEVLPELTEDEKISVEAIVNTHHHYDHADGNADILKYLKEKNPTSKVEVIGGSKDCPKVTIIPENLKKLHLGDLEITCIRTPCHTRDSICYYVKDPTTDERCIFTGDTLFTAGCGRFFEGTGEEMDIALNNSILETVGRQNWSKTRVYPGHEYTSDNVKFVRKIYPQVGENKALDELEQFCSKHEVTAGRFTLKDEVEFNPFMRLEDPKVQKAAGDTNNSWDRAQIMDKLRAMKNRM

SEQ ID NO: 9747 - protein, 333 aa, Cryptococcus neoformans
MAPASHFTFNNGKKIPSIGLGTWQSEPGQVAKAVESALKSGYRHIDCAWAYGNEKEVGEGLKASGVPREEIHITSKLFELHHHPEHVELACKDTLKNLGVEYLDLYLLHWNINFQVDAPKGTVPTFDHAVKADNGKIKLDVALADNVMPTWREMEKLVEKGLVKSIGISNFNIHRTEKLLKEAKIKPVADQVELSIQCPQHELVAYLKSKDILPQGYSPLGGTGKSNLRENDVVQKIADKYKVQTANILLSWLVMRGINPVPKSVTPERIANNLKLVDLSQEDFKELEKLAESHPPKRVCDQSEDFEPKYDIFQENDPEFSDKAQFAKLGLKL

SEQ ID NO: 9748 - protein, 564 aa, Xanthomonas axonopodis
MCSIFGIFGLQPGDDLQALRRQALECSQRQRHRGPDWSGVYVDTGAILVHERLAIVDPAGGSQPLLSEDGQLALAVNGEIYNHRELKAELLQPYAFQTGSDCEVINALYREDTPASYLNRLNGIFAFALWDKTEGRVIIARDPIGVVPLYWGHDREGRLRVASELKSLVDDCADAAQFPPGHWYDSATGALNRYYERAWRQYGAVEGVQVQLQELREAFERAVHRQLMTDVPYGVLLSGGLDSSLVAAVAARYARHRIEENDITEAWWPRLHSFAIGLKGSPDLAAAEVAAAALGTVHHGFEYTFDEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSSGATRMEKGVLREAFAGYLPESILWRQKEQFSDGVGYGWIDGLKAHAQSQVSDRELAAADRRYPVNPPQTKEAYFYRSLFEQFFPGQAAAETVPGGKSIACSSPTAIAWDASFAAMADPSGRAIAGVHAQALAS

SEQ ID NO: 9749 - protein, 730 aa, Ralstonia eutropha
MGALVEGRHRDPFAILGPHRDGDTLIVRACVPGAHSVMLADSRGEPLAPMTPLHAGGVFTGRLPAGVSVYQLLVRWHNGTQQVSHDPYAFGLLLGELDLHLIAEGRHFELGACLGAQWRNVDGVQGVRFAVWAPNARRVSVIGDFNGWQPARHPMRLRHPSGVWELFIPEAMGARPGCRYKFDLLDPHDAQLPDKADPLALATEAPPATASVVTQPQVSAPPFAWQDDEWMRLRNAVDPYAAPLSIYEVHVGSWLRAANDPARGWEVLADRLIPYVHELGFTHIELLPVTEHPFGGSWGYQPLSLYAPTARLGPPQAFAAFIDRCHRDGIGVILDWVPAHFPTDPHGLARFDGTALYEHEDPREGFHQDWNTLIYNLGRNEVRGFLLAGALHWLEHFHVDGLRVDAVASMLYRDYSRAPDQWVPNRFGGRENLEAVAFLRELNTVVHERCPGALTIAEESTAWPGVTASAASGGLGFDFKWNMGWMHDTLRYLSLDPIHRAWHHQDMTFGTVYAWSEAFVLPLSHDEVVHGKGSMLRKCPGDDWQRFAGLRAYYGFMWAHPGKKLLFMGGELAQWQEWNHDAELDWALLDHPMHRGVHTLVRDLNALYRELPALHELDHSPAGFQWVVGDDHQNSVFAWLRRPAPGSGDVVLAVTNMTPVPRYGYRIGVPSEGCWHERLNTDAACYGGSNLGNGGAVTAEPVPSHGQEASVLLTLPPLATVILQHAGTQA

SEQ ID NO: 9750 - protein, 661 aa, Ralstonia eutropha
MNLTSFFLGTGATSATPRLAPLDSFSASAPQVPAANDDPHSYAFGPVWLPEGRIGFRLWAPDAAQRGESVRLEIAGMGPVRMTACENGWYRAAVPCADGTRYWFRLDDGTTFPDPASRWQPNDVHGPSVACQPKARTYPWKCPDWRGRPWHEAVICELHVGLCGGYAGAMAQLQRLSALGFTAVELMPLAEFPGARNWGYDGVLPFAPESGYGKPDDLRALVDEAHSLGMMVLLDVVYNHFGPEGNYLHHYASAFFRQDRQTPWGPALDFRRREVRRFFTENARYWLEEFRFDGLRLDAVHAIDDEGWLTTLPSDLRALHGLQGRHVHLVLENDHNDASLLSAGFDAQWNDDAHHALHVLLTGEQDGYYRDYGATPGRPANTSQNAGQNTPLRHLARVLREGFAYQGEVSPYRSECDPAQGPVRRGKPSGHLPPTAFVSFLQNHDQIGNRAFGDRLATLADPDALRVAVALQLLCPQVPLVFMGEECGAQTPFYYFTSHPPELAEAVRQGRRQEFAGMAAFRDESQALEIPDPNDPATFEASRPPMDVENDWTRYYRRLLAIRREWLMHRLPRARISGVDVLGPAALRARWRLGDGTCLSIWVNLGEHVAACQPPAPGYAVLHETASGHADAVAGGSLPAMSCIAILSGHGEQAHGAGGAR

SEQ ID NO: 9751 - protein, 1679 aa, Aspergillus nidulans
MSELWYQRPAAGWDEALPVGNGRLGAMVYGRTDTELLQLNEDSVWYGGPQNRLPEDALKCLPRLRELIREGAHKEAERLARRAFFASPNSQRHYEPLGTLFLEFGHPCEEVTGYRRSLDLNEGITHVHYEHNGVQYHRQVIASYPDNVLAMRVQASRCSEFLVRLSRLSELEYETNEFLDDLVVDGQSIKMHVTPGGKDSNRACCMVAIRCGSDDQEPIKVDCVGKNLIINARDALIVIVAQSTYRCDDADLDRATVADLEAVLASSVEDIWARHITDYQSLYGRLELNLGPDATDIPTDQRILHVRGPELVAIYLRYSRYLLISCSRPGRKGSSDRVLPATLQGIWNASFHPPWGCRYTININLQMNYWPANVGNLLECEEPLFALLERLAVTGTETARKMYGCRGWTVHHNTDLWADTAPVDRWMPATLWPLGGAWLCTHVWERFLFNGNKAFLKRMFPVLRGCVEFLQDFLVDDVSGQYKVTNPSLSPENTFRDEKGQEGVLCEGSTIDIQLVRAVLKAFVESLEVLGYSQDELLPSVHDTLRRLPPARIGSKGQLQEWMFDYDENEPGHRHVSHLWALYPGNDINLETTPELAKACAVTLQRRQAAGGGHTGWSRAWLLNLHARLRDADECAEHLERLLAQSTLPNLLDTHPPFQIDGNFGGGAGILEMLVQSHEDGIIRLLPACPLAWRSGRLRGVRARGGFELEFEWKDGVIRGPEASAFFYTSHSRCEDSTTYGKHNALGISTIMDLTSVQDLKGALRNDFFHGYATAAAQVEGAWNKDGKGPSIWDTFGHTPGKVKDNSNADDAVRFYDFYREDVALMKSYGVNAYRFSLSWSRIIPLGGADDPVNEQGIKYYQDLVDELLNNGITPFVTLFHWDVPQALEDRYGGMLNQERFIPDFVRYARVCFERLGPKVRHWITFNEPGVYSLAGYAAGVHAPARSSFRELNEEGDSSTEPFIVGHTELVTHGHVSKLYREVFQPQQKGTIGITLHGNWSEPWDEDDPRDQEAAERAREFEIAWFADPLYKTGDYPASMRAQLGDRLPRFTPEESKLVLGSSEFYGMNSYTTFFVQHKDTPPDINDHKGNVIVHDTNSKGVSRGEESDTPWLRTAPTGWRKLLNWIWNRYHVPIYVTENGTTAKGETAPTPEVLIDTFRMRFFEGYVGGLARAVKEDGVDIRSYFAWTFTDNWDRKGPIQMVEIFRRSYASTVRPATAPRPSPNVKHVRENAELYAQNCRDRNYPAHAEYPFKIQQLSEELRQIDKQLMPFRSRIKALERTIGRLQNPATGPEEKEQEPAIRAEAQQLKNESAALITRRELCDEQIHDLALSLPNLTSPHTPVGLEPALVEYLNFDPQSPPAWVSSPDPLRSHVSIGTDLGLIDFTSAATTTGWGWYFLTGDGALLEQALIQYSLSVARRHGWTPISPPSIVWSYLTEACGFQPRDQNNEQQIWAIEQAEKDKAKPPRSLAATAEIPLAAMHARNELDPAALPIKLVGPSRCYRAEAGSRGVDTKGLYRVHEFTKVEMFGWADSSPTSSSPTSDDLFEGLLTVQKEILTSLQLPCRILEMPTSDLGASATRKRDIEALFPSRMRGNGLEDAWGEVTSASICTDYQSRRLGTRVRGVKSVFPHTVNGTAVAVPRVLAAILENGWDAERKVVVLPEVLRPFMGGAEVIGK

SEQ ID NO: 9752 - protein, 354 aa, Pseudomonas putida
MTKLFSPVQLGPLNLPNRVVMAPMTRSRALGNVPNDLMAQYYSLRAEAGLLITEGTSPSPNGLGYAHIPGIYSDAQVAGWRQVAEAVNAAGGRVFVQLMHTGRVGHPANLPLGAHLLAPSAVAAPGEMWTDTEGMQPHPVPGTMTEQDIAAAIEEYAAACKNTVAAGFDGVELHGANGYLIDQFLNTASNHRSDRWGGSIDNRIRFAVEVARAAAAAIGAERVGIRISPYGVFNGMASDADMDALYLRLIEALNDVGLVYLHVVDHSSMGAPPVSETLKVQLRTAFRGKYILSGGYDAARTNADLAANKGDLVAFGRPFIANPDLAQKLKSGGELKPADPATFYTPDAKGYTEF

SEQ ID NO: 9753 - protein, 638 aa, Streptomyces verticillus
MRPVCGIVAIRSADGGLDGGELTAPMADLRPRGPDGEGTWVSPTGRAALGHTRLAVIAPDAGRQPVAGPDGTVRLVVNGEFYGYREIRAELRAAGCRFRTGSDSEIALHLYLRDGRRALERLRGEFAFVLWDERRATLFAARDRFGVKPLYYTERDGRLYVASTVRALLSCGAPARWDTAAFAAHLQLGLPPDRTLFAGIRQLPPGCHLIADAHGTRVTPYWDLDYPPAGELAARGSLDDHLDAVRERTDEAVRLRTVADVPLACHLSGGLDSSAVAASAARHTRLTAFTVRFDDPAFDESAVARRTAAHLAIDHREVASERAHFADHLRDVVRAGEMVQENSHGIARYLHSAHIKKAGFTAVLAGEGGDELFLGYPQFRKDLTLSLSADARDKADRGYARLVAAGLLPPYLRTLLGTLGFLPSWIVDRHLAVTQPVAALLRPDFAAELARADAAAPLLAAGAGLLAGRAPAHQATYLFAKTWLPGYLLAAERLDAAQAVEVRLPLFDHHLFDLVRHTPPAWYDKDGTGKYPLRAAMRHRLPREVTEGRKQGFLAPPMADDDTLLDALRERLAGPGAGDDPFFDPHAVRALLDRLAAAPPGQRSGGEKLLQLVASTAELADEFGLTTAPSGQKGGNGG

SEQ ID NO: 9754 - protein, 513 aa, Arabidopsis thaliana
  misc_feature (500)..(500): Xaa can be any naturally occurring amino acid
MDHSSNRFGNNGVESILPNYKLGKTLGIGSFGKVKIAEHVVTGHKVAIKILNRRKIKNMEMEEKVRREIKILRLFMHPHIIRQYEVIETTSDIYVVMEYVKSGELFDYIVEKGRLQEDEARNFFQQIISGVEYCHRNMVVHRDLKPENLLLDSRCNIKIADFGLSNVMRDGHFLKTSCGSPNYAAPEVISGKLYAGPEVDVWSCGVILYALLCGTLPFDDENIPNLFKKIKGGIYTLPSHLSSEARDLIPRMLIVDPVKRITIPEIRQHRWFQTHLPRYLAVSPPDTVEQAKKINEEIVQEVVNMGFDRNQVLESLRNRTQNDATVTYYLLLDNRFRVPSGYLESEFQETTDSGSNPMRTPEAGASPVGHWIPAHVDHYGLGARSQVPVDRKWALGLQSHAHPREIMNEVLKALQELNVCWKKIGHYNMKCRWVPGLADGQNTMVNNQLHFRDESSIIEDDCAMTSPTVIKFELQLYKAREEKYLLDIQRVNGPQFLFLXDLCAAFLTELRVI

SEQ ID NO: 9755 - protein, 302 aa, Synechococcus elongatus
MQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 9756 - protein, 425 aa, Nostoc punctiforme
MGYYIAPRFLDKLAVHITKNFLKLPGVRVPVILGIHGRKGEGKTFQCQLVFEKMGIEVTHVSGGELESPDAGDPARLIRLRYRETAELIKVRGKMCVLMINDLDAGAGRFDEGTQYTVNTQLVNATLMNIADNPTDVQLPGSYDSTPLHRVPIIVTGNDFSTLYAPLIRDGRMEKFYWEPDRDDKVGIVKGIFEPDGLSQKEVEQLVDTFVNQSIDFFSALRSRIYDEQIRNYIHQVGFERVSLSVVNSTEGPPEFKKPDFRLSHLIESGNFLVGEQKRVENSHLVDDYNRLNRGRNSQSASPAATPINQPSSNGATQEAKTNGNGFQKQEGLSSHLTLDTQAQIRQLLSQGYKISIEHVDERRFRTGSWQTCVHSHIDAESDAISNLEATLAEYSGEYVRLVGIDPKAKRRVVETIIQRPDGKN

SEQ ID NO: 9757 - protein, 493 aa, Rhodopirellula baltica
MSEESKCPFQTQQFGRAVDDNQHSQTAGPRGPVLMQDVHLVEKMAHFNRERIPERVVHAKGFGAFGTFTVTNDITKYCMADLFSEVGKKTETFARFSTVGGESGSADTARDPRGFSLKFYTDQGVWDLVGNNTPIFFIRDPLKFSDFIRTQKREPQNHLQPHWRRWDFWGEVPEALHQVMFLYSDRGTPKSARFMNGYGSHTFSMYNKDGVRHWVKFHLKTEQGSENFSADEAIKMAGEAPDYSTRDLFEAIEKGDFPRWRMHIQVMPESDAADYEWHPFDLTKVWPHDDYPLIEVGVFELNRNPSNYFQDVEQAAFEPGNLVEGIGISPDRMLQNRVLSYPDAHRYRLGVNYHQIPVNQPRCPYATYHRDGTMRVDGNGGGTVDYEPNKMNGPKETGRTMEPPMPVHGDGDRYDEFACDDKDYYGQPQMFWNKVLDEGARERLCTAISNSMADSPENIREKMLAQFGKVHPDFEEGVRSRLDAPKSQPIPIA

SEQ ID NO: 9758 - protein, 375 aa, Bacillus cereus
MTSSNNKAASIYEGTNINAGGSFENIEETKLFNPIQIGSWSLRNRIAMAPMTRCFANHETGVVGTDVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQAVIGQYAQAAKNAIEAGFDGVEIHGAHGYLIDQFTYEFANKRTDKYGGDLKERLTFMKEVTAAVIEAVGANKTLLRFSAFKGDNPTYMWENPELAIETFVNMFKEVGLTMIHPSTMNYTAVIADGKNFHQLVRKYWDGTIVGVGNLNPKEAEEALQEGIIDVAAFGRPLIANPDFVHRIKNAESLVEYDAKEHLATLV

SEQ ID NO: 9759 - protein, 371 aa, Candida albicans
MLIKSNYNCINIKRFLLNQTRVSVTASNSFSFYFYFKPYKFNCYKSYSTMSTTTPTIKLNSGYEMPIVGFGCWKVTNATAADQIYNAIKTGYRLFDGAEDYGNEKEVGEGINRAIKDGLVKREELFIVSKLWNNYHSPENVEKALNKTLTDLNLEYLDLFLIHFPIAFKFVPLEEKYPPGFYCGDGDKFHYENVPLLDTWKALEKLVNLGKIKSIGISNFNGGLIYDLIRGATIKPAVLQIEHHPYLQQPRLIEFVQNQGIAITAYSSFGPQSFLELQSKRALDTPTLFEHETIKSIADKHGKSPAQVLLRWATQRNIAVIPKSNNPDRLAQNLAVVDFDLTEEDLQAISKLDIGLRFNDPWDWDKIPIFV

SEQ ID NO: 9760 - protein, 365 aa, Methanosarcina barkeri
MIFDPITVCNLELQNRFVRSATHEFLAEEDGTPTSKLEDLYEELAKNEVGMIITGYSYVLPGGQSDIYQQGIYDDRFIEPYKKITEKVHRYRSKIVLQIVHGGRQASVSDEYPVPMAPSEVKDSHSAVVPREMTEQEILKVIEAFTKATVRAKKAGFDGVQLHCAHGFLLSNFISPYTNRRTDRWGGSVENRTRIVTEIVRRIKEEAGDSFPILVKMNATDGFQPCCSKAELGLDIFQAVEIAKLLEKAGVCAIEVSGGIGEAGGVTIRTAINTPAKEAYFRDCSKAIKSAVNIPVILVGGIRSLSVINDLLENGSADMISMSRAFISEPDIVLKFKSGKVKKARCVSCNLCFDPEGISCNFQFE

SEQ ID NO: 9761 - protein, 258 aa, Pseudomonas aeruginosa
MIQIDALPAFNDNYIWLLQDATSRRCAVVDPGDAKPVEAWLAAHPDWRLSDILVTHHHHDHVGGVAALKELTGARVLGPANEKIPARDLALEDGERVEVLGLVFEIFHVPGHTLGHIAYYHPAETPLLFCGDTLFAAGCGRLFEGTPAQMHHSLARLAALPANTRVYCTHEYTLSNLRFALAVEPDNAALRERFEEATRLRERDRITLPSEISLELSTNPFLRVSENSVKKKADQRSGQQNRTPEEVFAVLRAWKDQF

SEQ ID NO: 9762 - protein, 397 aa, Lotus corniculatus
LKKERLVKQIKREVSVMRLVRHPHIVELKEVMATKTKIFMVVEYVKGGELFAKLTKGKMTEVAARKYFQQLISAVDFCHSRGVTHRDLKPENLLLDDNEDLKVSDFGLSSLPEQRRSDGMLLTPCGTPAYVAPEVLKKKGYDGSKADIWSCGVILYALLCGYLPFQGENVMRIYSKSFKADYAIPEWISPEAKNLISKLLVVDPEKRYSIDEIMRDPWFEIGFMRPLAFSMKASAVDDTVIDFNDDVVEDLDPKSDVGGGEFVEAARPSYNAFEIISSLSHGFDLRNLFETRKRSPSTFISKLSASAVVAKLEAVAKKLNLRITGKKEFMVRMQGVTEGRKGKVGMTVEVFEVAPEVAVVEFSKNAGDTLEYIKLCEDQVRPSLNDIVWSWQGQGSS

SEQ ID NO: 9763 - protein, 568 aa, Candida albicans
MVLSKHIDALRLESQILKKTPQAQLRKEAFIDAYDSHKNIPQFEIPQNSSNEQLIYKYLSQELALDGIPTLNLASFVNTYVDDTSARLIQDNLTKNLADNDEYPSLIDIQTRCISILSNLWHAPGKVDKVTGNRVTNSIGTATTGSSEAIMLAGLALKKRWQLKRKAEGKSTDNPNILMATCAQVALEKFACYFDVENRLIPVTEESGHLIDVSKIKENIDENTIGIFVIMGSTFTGAFEPVEEISKLLDEVEKERGLDIRIHVDGASGGFVAPFIFPHLKWDFAVPRVDSINTSGHKFGLTSVGLGWVIWKDADLLPKELRFSLDYLGGVEETFGLNFSRPGFPVITQYYNFLSLGRQGYAKIFDGCMTNARLLSRFLEESKYFDVVSVIHHKLSDSEKKAQFIREVDDKKLDSKLYTINEEFKPGLPVVAFRFSKEVRDKYPELPQELLSTLLRKRGYIIPNYHLPPSENDKEILRVVVRNSLSLNLLERLIQDITDATELLIKAADSIADYVSTSGEHTDVENRERIHKLLAAIASGGVAEVKEEKHKKDNHQGSKNKKSYRGTC

SEQ ID NO: 9764 - protein, 372 aa, Annona cherimola
YETDPYHPITNPRGVIQMGLAENQLCSDLIEEWVRRNPSSSICTPEGASEFKEIAIFQDYHGLPAFRKAVANFMEKVRGGRAKFDPDRIVMSGGATGAHELIAFCLADPGDAFLVPTPYYPGFDRDLRWRTGVQLVPVECHSYNNFKVTRSALEAAYMKAQEENIRVKGLLITNPSNPLGTILDRETLESIISFINEKSIHLVCDEIYAATVFSSPPFVSIAEILTDVPHCNLDLVHIVYSLSKDLGLPGFRVGVVYSYNDHVVRIGRKMSSFGLVSTQTQHLIASLLSDDAFVNKFIVESARRLAERHSTFTRELARVRISCLKSNAGLFCWMDLRALLKEPTVEGEMELWHTIVNVIKLNVSPGASFHCS

SEQ ID NO: 9765 - protein, 324 aa, Neisseria meningitidis
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 9766 - protein, 444 aa, Kluyveromyces lactis
MSNEEFIRTQIFGTVFEITNRYTNLNPVGMGAFGLVCSATDTLTSQPVAIKKIMKPFSTSVLAKRTYRELKLLKHLRHENLICLEDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFSSRFQNLEPDAIDLLEKMLVFDPKKRITAADALAHPYLSPYHDPTDEPIAEAKFDWNFNDADLPVDTWRVMMYSEILDFHQIGDPQINTNATFDDQVAAATVAAAEAASKQQQQQQHQTEEQTQQTIASTPPQAQVTPQQLESGANSNSNSNPSFSIGPDPANETLTNFANQADQYVSKFK

SEQ ID NO: 9767 - protein, 417 aa, Nocardia farcinica
MGHVSPHLPHRPPRVLEQSTKLQNVVYEIRGPVHAHAARLEAEGHRILKLNIGNPAPFGFEAPDVIMRDIIAALPYAQGYSESKGILSARRAIVTRYELVPGFPEFDVDDVYLGNGVSELITLTMQALLDNGDEVLIPAPDYPLWTAMTSLAGGTPVHYLCDESNGWQPDIADIEAKITDKTKALLVINPNNPTGAVYSAEVLQQIVDLARKHQLLLLADEIYDKILYDDAKHISLATLAPDLLCLTFNGLSKAYRVAGYRSGWMVITGPKEHATGFLEGIDLLATSRLCPNVPAQHAIQVALGGHQSIEDLILPGGRLLEQRDVAWERLNMIPGVSCVKPKGALYAFPRLDPEVYEIHDDSKLILDLLLQEKILMVQGTGFNWPAHDHLRIVTLPWARDLAVAIERFGNFLASYRQ

SEQ ID NO: 9768 - protein, 614 aa, Oceanobacillus iheyensis
MCGITGFVNWGKTADEQRSVLGKMTDTLSLRGPDDTQLWTKGHTGFGHKRLSVVDLEGGKQPMSKTVNGITYTVCYNGELYNTEDLRKELLKRGYTFSTTSDTEVLLTSYIEWKEACVDHFNGIFAFGIWDEEKEQLFMSRDRLGVKPLFYAEKAKGFIFGSELKAILAHPDISTKVDRTGLSEIFGLGPSRTPGHGLFKDIDELRAAHSLTFSKHGLKVWRYWNMVSNHHTDSEEETAEKVRELFVDAVQRQLVADVPVSTLLSGGLDSSAITAIAANYYKEKGYGPLTTFSIDYQGNEQHFQKSKFQPSSDRAWIEKMVEGFSTDHHDEIIAGQELAILLKEAVEVRDQPGQADIDSSLLWFCREIKQHTTVALSGECADEIFGGYPWFHDPAAAGNNFPWIRSLDSRIDLLHGDWKKKLDLESYVQEQYQSTIAETPRLDGEDKIDAKRRELFYLNMQWFMSQLLDRKDRMSMGASLEVRVPFADHRLVEYVWNIPWDIKMVNGHEKGILRKAMEGILPNEVLYRKKSPYPRTFQPEYTEQVSQWMNRILVDPNARLFEFMKKEKVEAIVKSKGKEFKDPWYGQLMRGPQLIAHLCQIDHWLRQYDVEVVD

SEQ ID NO: 9769 - protein, 372 aa, Bacillus subtilis
MNPKYKPLFEPFTFKSGVTINNRIAVAPMTHYASNEDGTISEAELDYIIPRSKEMGMVITACANVTPDGKAFPGQPAIHDDSNIPGLKKLAQAIQAQGAKAVVQIHHGGIECPSELVPQQDVVGPSDVFDNGKQIARALTEEEVENIVKAFGEATRRAIEAGFDGVEIHGANGYLIQQFYSPKTNQRTDRWGGSDEKRLAFPLAIVDEVKKAASEHAKGAFLVGYRLSPEEPETPGLTMTETYTLVDALGDKELDYLHISLMDVNSKARRGADPTRTRMDLLNERVGNKVPLIAVGSIHSADDALAVIENGIPLVAMGREILVDPNWTVKVKEGREKQIETVIKGTDKEKYHLPEPLWQAIVNTQGWVPYKD

SEQ ID NO: 9770 - protein, 355 aa, Lycopersicon esculentum
MESTDSSTGTRHQPQLPPGFRFHPTDEELIVHYLKKRVAGAPIPVDIIGEIDLYKFDPWELPAKAIFGEQEWFFFSPRDRKYPNGARPNRAATSGYWKATGTDKPVFTSGGTQKVGVKKALVFYGGKPPKGVKTNWIMHEYRVVENKTNNKPLGCDNIVANKKGSLRLDDWVLCRIYKKNNTQRSIDDLHDMLGSIPQNVPNSILQGIKPSNYGTILLENESNMYDGIMNNTNDIINNNNRSIPQISSKRTMHGGLYWNNDEATTTTTTIDRNHSPNTKRFLVENNEDDGLNMNNISRITNHEQSSSIANFLSQFPQNPSIQQQQQQQEEVLGSLNDGVVFRQPYNQVTGMNWYS

SEQ ID NO: 9771 - protein, 255 aa, Brassica napus
GDIHGQYQDLLRLFEYGGYPPSANFLFLGDYVDRGKQSLETICLLLAYKIRYPSKIYLLRGNHEDAKINRIYGFYDECKRRFNVRLWKIFTDCFNCLPVAALIDDKILCMHGGLSPELDNLNSIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 9772 - protein, 407 aa, Synechococcus elongatus
MIQPFLKRSLLWLTLLFWFATATPALALTEEQKLFNEAWRIVNQSYVDPSFNHSNWFQLREKILKKPLDNRDQTYTAIEGLLAKLDDPFTRLLRPDQYRNLQVSTAGELSGVGLQIGFEAESGDVVVIAPIEGSPAALAGLLSGDRILTVDGVAISGRDLDEAAARMRGPRGTTVALQVLRDQQTLDFELVRDRISLNPVRSQLDRDGDHPPIGYIRLSQFNANASVEVAHAIAQLDQQGAEAFVLDLRNNSGGLLTAGIEIAREWLNEGAIVYTVNRQGVLDSFAANGQALTDKPLALLVNRGTASASEILAGALQDNERAILVGDRTFGKGLIQSLFELSDGAGLAVTVAEYETPNHNDINKQGIQPDLAVEQSEPLFAEAIASAAVRQYQAAVTALTEQVRHRA

SEQ ID NO: 9773 - protein, 246 aa, Cucumis sativus
MGRGRVELKRIENKINRQVTFAKRRNGLLKKAYELSVLCDAEVALIIFSNRGKLYEFCSTSNMLKTLERYQKCSYGAVEVTKPAKELESSYREYLKLKSRFESLQRTQRNLLGEDLGPLNSKELEQLERQLVSSLKQVRSTKTQYMLDQLSDLQNKEQMLIETNRALQIKLEEISSRNNIRLTWDGGDQSMSYGPQNAQTQGFFQPLECNPTLQIGYTSAVSDQITSTTTPTHAQQVNGFLPGWML

SEQ ID NO: 9774 - protein, 527 aa, Lycopersicon esculentum
MEPNSYGSGKAAVGDGVGAPMLQTAPAPAPIPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGNAQQQMQPPGHSASVGACVEVGKFGLEEEVERLKRDKNVLMQELVRLRQQQQATDNQLQGMVQRLQGMELRQQQMMSFLAKAVNRPGFLAQFVQQQNESNKRIAEGSKKRRIKQDIESQDPSVTPADGQIVKYQPGINEAAKAMLRELSKLDSSPRLDNFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTSAVEGKVGLDIIGSCLSPGADIDWQSGLLDEIEEFPSVGDPFWEKFLQSPCSPDAAMDDDISNTSETKPQINGWDKTQNMEHLTEQMGATNIKQQKHMI

SEQ ID NO: 9775 - protein, 154 aa, Lycopersicon esculentum
MSLIPRIFGDRRSSSMFDPFSIDVFDPFRELGFPSTNSGESSAFANTRIDWKETPEPHVFKVDLPGLKKEEVKVEVEEDRVLQISGERNVEKEDKNDKWHRMERSSGKFMRRFRLPENAKMDQVKASMENGVLTVTVPKEEVKKPEVKSIEISG

SEQ ID NO: 9776 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDTNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQVAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQHHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIANNGDANYYLMEAYKHLKPIALAGDARKFKATIKVADQGEEGIAEADSADGSFMDELLTLMTAHRVWSRIPKIDKIPA

SEQ ID NO: 9777 - protein, 122 aa, Triticum aestivum
  misc_feature (38)..(38): Xaa can be any naturally occurring amino acid
  misc_feature (44)..(44): Xaa can be any naturally occurring amino acid
  misc_feature (95)..(95): Xaa can be any naturally occurring amino acid
FVEGGPCLLYWWPPPPCWGGPRPLTEGALEDSQGRLDXGFGFSXTRFPGLFGTLPGLELCNSITGRFLDEKRAVVGQLEPAAAAPAPIPDWKISXPGDNPEEVKARLKYWAQTVACTVKLCS

SEQ ID NO: 9778 - protein, 274 aa, Rhodospirillum rubrum
MHRVSANGIAIPALGFGTWQIEGDDARVAVAEALALGYRHIDTARAYGNEAQVGAGIAQSGVPRGDIFLTTKIWTSEFKPEALTAALADSLAKLGTDYVDLTLLHWPNPEVPLADSLGALAALQQEGLTLAIGVSNFPVALVEEAVAVCGRPLAVNQVEYHPFLDQSKVIEACRRHGMAVEAYSPLARGKVMEDATLRRIAEIYGRTPGQVALRWLIQQDGVIALPKAVRPEHAKANLGALDFALSQSEMAEISALARPDGRLINPSWAPAWDD

SEQ ID NO: 9779 - protein, 275 aa, Bordetella pertussis
MAQVPVLKLNDGNAMPQLGLGVWQVPNDQAAASVKAALAAGYRSIDTAAIYGNEAGVGEGLRAAGVARKDLFVTTKLWNDRHGYDEAQRAMDESLRKLGLAYVDLFLIHWPVAGSDKFVDAWRAMVAMKEDGRARSIGVSNFTIANLRRLVDETGVVPAVNQVELHPGFAQRELRAFHAEQGIATESWSPLGQGAVMHDATLAGIAARHGKSAAQVTLRWHLQNGLIVIPKSVTPARIQANIDVFDFELSADEMADIDALPEGPRLGPDPATFTG

SEQ ID NO: 9780 - protein, 140 aa, Triticum aestivum
MVSFEMNDLKKIGLGLTGFGVFFSFLGIVFFFDKGLIAMGNILFLSGLGMTIGLKSTMQFFTKPKNYKGTISFGAGFFLVLIGWPFFGMLLEAYGFIVLFSGFWPTLAVFLQRIPILGWIFQQPFVTSFLDRYRGKRVPV

SEQ ID NO: 9781 - protein, 401 aa, Xanthomonas campestris
MLSDPIIDVLTSGVAGLGVWGMLAVLLVFTQLTIFAVTLYLHRSQAHRGVDFHPAIAHFFRFWTWLTTSMITREWVAIHRKHHAKVETEEDPHSPQTKGIGQVFWRGVELYRQARAERADIEQYGKGAPSDWIERHLYTPHANAGPMALLVINSVLFGLPGIALWAIQMAWIPFWAAGVVNGLGHWWGYRNFESADTSTNLTPWALWIGGEELHNNHHAFPSSARFSMRRWELDIGWVAIRGLQALGLAKVLRVAPSLDIRPNIAVPDADTLKALLSHRFQAMTDYQRNVLKPALREEAAVTGAKLRELLPRRLRKGLVDDGRWLKPDARAQLQAWVAQRPRMRTLVEYRARLTAVLEARSHDASERLRQLQQWCHEAEASGNAALQAYAARLKGYALSGA

SEQ ID NO: 9782 - protein, 361 aa, Corynebacterium glutamicum
MTSLLTPIAIRGLEIPNRMWLAPMCQYQANNLDGVPLDWHLVHYGARAVGGFGLLIAESTGISPEGRISSRCTGLWNEAQVEAWERITNFVHAQGGLIGVQLNHAGRKASTYPALPNFPTGTQSVDEGGWETFGPSGVAQPGLADPTELTREGIEKVIQDFAAAAERAVRAGFDAVEVHGAHGYLLHQFLTPVANKRTDIYGGSFENRTRLFREVAQAIRAVIPGSMPLIARISATDWIDDEPSWDDDQTVSLVSDLKKLGVDAVDISTGGAVPATIPVEPSYQVKFARRVKQEVGIPTSAVGLITHVGQAQGHLDRGDADIISLGRAALRYPSWPLFAAHELGKTRDEIPYPPSYVRGAW

SEQ ID NO: 9783 - protein, 256 aa, Alkalilimnicola ehrlichei
MTEIVAIPAFADNYIWLAVDRNRRLAAVVDPGDAEPVEAALRASGLRLSAILITHHHHDHTGGVEELLAAHPVPVYGPADESVPGVSQPLREPDAFEVPGLGLPLRVLDVPGHTAGHIALVADGALFSGDALFAGGCGRLFEGTPEQMYASLGKLAALPEATRVYCGHEYTLANLRFAHQVEPDNPNLTQRLRQAEAARQRGEPTVPSRMADEHATNPFLRAHLPAVRTAAERWSGQTLDEPVAVFAALRRWKDQS

SEQ ID NO: 9784 - protein, 478 aa, Leuconostoc mesenteroides
MSKRLSEDFLWGGAVAAHQLEGAWQEGGKGVSVADIMTVGGPDKERNITKGVVSGEYYPNHEAIDFYHRYKADIALFKEMGFKCFRTSIAWTRIYPTGEESEPNEAGLKFYDDLFDELIKNNIEPVITLSHFELPYHLVTKYGGFRNRKVIDLFVKFATTCLKRYKDKVKYWMTFNEINNQANYDNDFLVFTNSGLHFNPGENREEGMYQAAHNELVASARVVKMGHDINPNFQIGCMIAMGPIYPASMNPDDVLAAQKSMEKNYFFADVHVNGQYPAFLTKYWTRKGFNIDVTQEDLADLQAGTVDYIGFSYYMSHAVKKPEGLNFDDMTPENSQVRNTYLAASDWGWQIDPKGLRYALNWFTDKYHLPLFIVENGFGAYDKVEEDGTIHDSYRIAYLQEHIREMKLAVVEDGVDLIGYTPWGCIDLVSAGTGEMDKRYGFIHVDKNNQNEGSLKRSKKDSFYWFKDVIATNAENIN

SEQ ID NO: 9785 - protein, 407 aa, Synechococcus elongatus
MIQPFLKRSLLWLTLLFWFATATPALALTEEQKLFNEAWRIVNQSYVDPSFNHSNWFQLREKILKKPLDNRDQTYTAIEGLLAKLDDPFTRLLRPDQYRNLQVSTAGELSGVGLQIGFEAESGDVVVIAPIEGSPAALAGLLSGDRILTVDGVAISGRDLDEAAARMRGPRGTTVALQVLRDQQTLDFELVRDRISLNPVRSQLDRDGDHPPIGYIRLSQFNANASVEVAHAIAQLDQQGAEAFVLDLRNNSGGLLTAGIEIAREWLNEGAIVYTVNRQGVLDSFAANGQALTDKPLALLVNRGTASASEILAGALQDNERAILVGDRTFGKGLIQSLFELSDGAGLAVTVAKYETPNHNDINKQGIQPDLAVEQSEPLFAEAIASAADRQYQAAVTALTEQVRHRA

SEQ ID NO: 9786 - protein, 434 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLTYRYFLSAFWANDENVRRALGVKKEVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 9787 - protein, 501 aa, Sinapis alba
MSTNKKTIVWFRRDLRIEDNPALAAAAHEGSVFPVFIWCPEEEGQFYPGRASRWWMKQSLAHLRQSLKALGSELTLIKTHSTVSAILDCVRATGATKVVFNHLYDPVSLVRDHTVKEKLVERGISVQSYNGDLCMSPGRYTVKRANLLLVLILTGKKCLDMSVESVVLPPPWRLMPLSAAETVWACSVEELGLENEAEKPSNALLTRAWSPGWSNADKILNEFIEKQLIDYAKNSKKVVGNSTSLLSPYLHFGEISVRRVFQCARMKQIIWARDKNGEGEESADLFLRGIGLRDYSRIICFNFPFTHEQSLLSHLRFFPWDADVDKFKAWRQGRTGYPLVDAGMRELWATGWMHNRIRVIVSSFAVKFLLLPWKWGMKYFWDTLLDADLECDIIGWQYISGSLPDGHELDRLDNPAIQGAKYDPEGEYIRQWLPELARLPTEWIHHPWDAPLTVLKASGVELGTNYAKPIVVIDTARELLTKAISRTREAQIMIGACGDEM

SEQ ID NO: 9788 - protein, 420 aa, Glomerella cingulata
MTTNGSDKPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKIGHGKPVDVWALGVITYFLLCGYTPFDRDSDFEEMQAILNADYSFTPFDYWRGVSEHAKDFIRKCLTIDPKKRMTAHEALQHPFVAGYLNGEGEGQNLLPTVKKNFNARRTLHAAIDTVRAINKLREGQQNLMDGAKSREPDRGLKSPPNAKKDDSAISMGNTNHKDSGYGTQPEADNQNDVCHDRCGTTPTSVPASLRVRAVSRTRSLRQAKDCGAVPQCDDSLEAV

SEQ ID NO: 9789 - protein, 478 aa, Unknown
  uncultured bacterium 580
MKPKTNIVWLKRDLRLTDHAPLYEATCRDEQFLVLYIYEPSLINDSHTDERHWRFIQQSLSVMEKILAKQSKQLSIAYGEADQIFSEIINQHEITNVFSHEETGLKLTYERDKKLKKIFNAKKIQWHEYQTNAVIRGLNNRKTWEKQWNKVMREEIKTINLAEANIISHNFPNYSIPKFRNDLNYQPGGCLPGQKEMHDFFETRGQDYFKFISKPDRSRTSCSRLSPYIAYGNLSMREVYQTLLKSWNKTGWRRSMAALSSRLHWHCHFIQKYESEIDIEDLPINRGYKDFPYKVINCEHEDFLAWANGETGYPLIDASMRALKKTGYLNFRMRAMVVSFACHYFMIHWKLVAKHLATLFLDFEPGIHYPQIQMQAGVTGINTIRIYNPSKQLQDHDPDTKFIRDWIDELSDQDKEYILGLPDDNFDLFSNSQNFYPTPAYDFFERTKYAKNLLWQWKKSSLVKSYNSKILSRHVKVR

SEQ ID NO: 9790 - protein, 397 aa, Rickettsia akari
MLSKLNKPALFALIFYPIFIISLVVKYSFNYGIGRTEVIFIIASYYINNITVGIGLHRLWSHNAYKINKCAEFVLIMLSAGTLQGPALSWASNHYKHHAKTDTDQDPHSPLKFDSKVLGFLWSHIGWMLVGSGSYKSIDRITWAKHGKNNLLKWQLKYYWQIAAFMNIVVPLFIGYLVDGTIQSAYAGFVFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLSYLSEKQKQKLTLMQAKIDHLLENLCLKIKELEESSITIKGQFKKSFVEIQESLKILAEQISSATQITEKPSEKLLKIVNKKIIDAEQSIYRLYNQFNTLKVSS

SEQ ID NO: 9791 - protein, 97 aa, Vigna unguiculata
MAALGGNRDVAGNQNSLEIDSLARFAVEEHNKKQNALLEFGRVVSAQQQVVSGTLYTITLEAKDGGQKKVYEAKVWEKPWLNFKELQEFKHVGDAPA

SEQ ID NO: 9792 - protein, 718 aa, Zea mays
PISLVRDRRLKEMLAAEGIVVQSFNSDLLYEPWEVVDDEGQPFTMFDPFWNRCLSMPYDPPAPLMPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVHVPMPARRRGDQMVPTMTTSSLNRAGTEVSADLVVANSEEEDTRAQVPFHAHLHLHPRAEAPPAARRTNNGARQHDVFQQRRNHRRDALLAPSASEASSSWTGREGAVVPVWSPPAASGHSDAFAADEADVSSRSYLGRHPQSHRLMNWSQLSQSSTAAEDSVRPNLIELKILVAIIDQTTKVFRIFLAFFGGGVAALVHWIEKRASDVMDADLGVEGHEHAPRQALRCVHVALLCVQSDRSRRPTMGQVIAMLSSGDDGTDDLPEPSLPGYVLRPMAASGVQLCFGCR

SEQ ID NO: 9793 - protein, 832 aa, Sorghum bicolor
MLCLVSPSSSPTPLPPPRRSRSPADRAAPPGIAGGSNVRLSVLSVQCEARRSGPRKVKSKFATAAIVQEDKTMATAKGNVDHLPIYDLDPKLVKFKDHFSYRMKKFLDQKGSIEENEGSLEEFSKGYLKFGINTSEDGTVYREWAPAAQEAELIGDFNEWNGANHKMEKDKFGVWSIKIDHVKGKPAIPHNSKVKFRFLHGGVWVDRIPAWIRYATADASKFGAPYDGVHWDPPASERYTFKHPRPSKPAAPRIYEAHVGMSGEKPAVSTYREFADNVLPRIRANNYNTVQLMAVMEHSYYASFGYHVTNFFAVSSRSGTPEDLKYLVDKAHSLGLRVLMDVVHSHASNNVTDGLNGYDVGQSTQESYFHMGDRGYHKLWDSRLFNYANWEVLRFLLSNLRYWLDEFMFDGFRFDGVTSMLYHHHGINVGFTGNYQEYFSLDTDVDAVVYMMLANHLMHKLLPEATVVAEDVSGMPVLCRSVDEGGVGFDYRLAMAIPDRWIDYLKNKDDSEWSMGEIAHTLTNRRYTEKCIAYAESHDQSIVGDKTIAFLLMDKEMYTGMSDLQPASPTIDRGIALQKMIHFITMALGGDGYLNFMGNEFGHPEWIDFPREGNNWSYDKCRRQWSLVDTDHLRYKYMNAFDQAMNALDERFSFLLSSKQIVSDMNDEKKVIVFERGDLVFVFNFHPKKTYDGYKVGCDLPGKYRVALDSDAFVFGGHGRVGHDVDHFTSPEGIPGVPETNFNNRPNSFKVLSPPRTCVAYYRVDEEAERLQAKAETTGSRKTSPDIIDVDATPVKTSTATKEDKEATSGGKEDASKKGWKFARQSSNKNTK

SEQ ID NO: 9794 - protein, 243 aa, Oryza sativa
  misc_feature (208)..(208): Xaa can be any naturally occurring amino acid
  misc_feature (231)..(231): Xaa can be any naturally occurring amino acid
  misc_feature (238)..(238): Xaa can be any naturally occurring amino acid
MTDPSRYKLNHSMIRIKDPKRSLEFYQFLGMTLINKLPNPDAKFDLYFLAYDSPKAVSHGNHWTDREGIVELTHNYGTEDDPDYQITNGNAEPYKGFGHLCISVDNLQAACQRLEDAGYKFQKKLTDGRMRHIAFVLDPDGYWVEVIGQKSLEQTENVKETDISTYRMNHTMIRVKDKDISLRFYQDVMGMKLKRTSESPNAGFNLYXLGYGPDAPQSTANGVNPGADHEXLLELTWXYGTEK

SEQ ID NO: 9795 - protein, 846 aa, Arabidopsis thaliana
MASSSLSNLMLAIHEKKTSSVDLYRPLRNYVTFTYSEREAQLIDDDLETLKQLRSDIERVSDPSPAARRELLISYYKVLCLVETRFPISPDKDHVNAVSFVWYDAFKQKHKATQQNIHLEKAAVLFNLGASYSQIGLGHDRTTVDGRRQASHAFMAAAGAFAHLRDNESIKATIGPSTTVDVSVECVGMLERLMVAQAQECVFENTIAKGSTPGVSAKIARQVGIFYEEALSALIISPLKDHFDKGWISHVQLKAALFYGEACFRYGKELHEKEEIAEEIARLRSGASRLAEAKKSSRGAPAQLIEAMNTLESSIDGNLDRAVKENDRVYLMRVPSPSSLSPLPAFSMVKPMNMTDILDASKEKMFSILVPDSSAKALSRYTEMVDDVIRTQAERLQQASELTRVRLKEMDLPDSILAVDGNSALPVDLKEDVEAVQISGGPAGLEAELQQLRDLKRVNQELLVHTEELLQKEATEDSQFRSQFGTRWTRPQSSTLTKNLQDRLNRFAANLKQAGESDVKIERSVRDNSALMSILDRRPIESAVPTLARPIMSLDATEDAIVGTLKQSLRQLENLGAQRAGLEDMLKEMKRKDDILPKLMTITGSYEDMFRKEISKYDHICEDISQNIEVQEQLLMQIQAQNEEFSTIFNLEDYKASKEKCYKQIQAAIMKYREIKENINEGLKFYVTLQDAITNVKQQCSDFVMTRSIQCRDMIEDVQRQMSGLSFQDHRSSGPYPSVHQPTASSPPPPPETQNPSHPHPHAPYYRPPEQMSRPGYSIPPYGPPPPYHTPHGQAPQPYPPQAQQQPHPSWQQGSYYDPQGQQPRPPYPGQSPYQPPHQGGGYYRQ

SEQ ID NO: 9796 - protein, 369 aa, Averrhoa carambola
PDQMGLAENQLCFDLIEDWVKNNPKASICTPQGVDKFKEIANFQDYHGLPEFRQAVAKFMGRVRGNKVTFDPNRIVMSGGATGANETIIFCLADPGDAFLVPSPYYPAFNRDLGWRTRVQLIPAECDVSNGFKITRSALEAAYQKAQEANVNVKGLIITNPSNPLGTTLDRDTLKSLVSFINDKNIHLVCDEIYVATVFSSPRFISVAEVIEEMDCNRDLIHIVYSLSKDMGFPGFRVGIVYSYNDAVVSCARKMSSFGLVSAQTQYMLASMLSDEIFVEKFLAESPKRLAKRYNKFTKGFEEVGINCLNSNAGLYFWMDLRWLLKEQSNKGEIDLWRIIVNDVKLNVSPGSSSHCNEPGWFRVCFAAE

SEQ ID NO: 9797 - protein, 454 aa, Lactobacillus gasseri
MPKDFFWGNSVSSMQTEGAWNEDGKGLSVYDVRPATENTTDWHTAIDEYHRYDEDLDLMKEMNMNMYRIQISWSRVCPEGDGKFNLKGIDFYDKLINAMLKRGIEPMICLYHFDMPLHLAKEYNGFMSRHVVDAFVRFGKKMIDHFSDRVKYWIVFNEHNLYFQDEVFNISGYEKGDKTLDDMYTIFHHTMISHIRLANYIHEKYDDVKIGGMLAYQQIYPETSKATDVWAAKQAQEFLNFNIYDADTGRGYSPEVMQYAKDHHINWDITDEDQEEMKKAQADFLAFSYYSSWTLSADKIPEDIAPNRYMNYGGVKNKYLKTNAWGWTIDPLGFRNAITTMYNHYKIPVFPIENGIGLKETWDGEHMIEDDERIAYHEEHIKAMKDAMFLDGAKVLGYLGWGLIDIPSSHADVEKRYGAVYVNRSNHDLKDLKRVPKKSFYWSQKVLKNNGDEI

SEQ ID NO: 9798 - protein, 69 aa, Brassica napus
DMYDFMAVDKQATPRVDRGIALHKMIRLITMGLGGEGYLNFMGNEFGHPEWIDFPRTDQQLPDGRVIPG

SEQ ID NO: 9799 - protein, 209 aa, Ricinus communis
MATVQGGVHDSPQGTANNAEIDGIARFAVDEHNKKENAMVEFGRVLKAKEQVVAGTLHHLTIEAIEAGKKKIYEAKVWVKPWLNFKELQEFKHATDVADTTASHPSFTSSDLGVKREGHGAEWKEVAAHDPVVQDAATHAVNTIQQRSNSLFPYQLQEIVHAKAQVVDDFAKFDMILKVKRGTSEEKFKVEVHKNNEGTFLLNQMEPHT

SEQ ID NO: 9800 - protein, 873 aa, Vibrio parahaemolyticus
MTLRSKTIIGIALIEALALGVLIISGLNWFKSSNETSLEVGSQNLVSVFAQASRDAVIATDLAYLDSFARSVVSEHKLAYIRIVNQDGIELTLQGDYTGVDTNVRPFDASDGVYDVAKAITLGDQTFGVVEMGVHVEHVHQMLSFATHASLVIAFVEMSLVALFSFALGSYLMKRLDLLRTGVIKVSQQGPGSQISISGNDEVTRVGEAFNQMSRSLAQAQNKLQQEHQTQQQLSAKISQLAEVAEHARDTIIITHPDGTIAWVNSAFEQLTEYSLEEVVGKSPGELLQGEDTDANTVALLSQSVRSHSPVRVEILNYTKSQRPYWVELELSPVFDENGELLRFIAVERDITDRREMEKRLSSALDKSKKATQAKSEFLANMSHEIRTPMNAIMGISEILLENENRREPRELLLLLHKSANNLVTIINDILDYSKVEAGKLTLVEEEFDLRSLVESCTALCAYQADKKNLKLLVDMPLAMNTVVVGDKGRINQILLNLIGNAVKFTDEGHVLLKVRESELGFDFSVTDTGIGIPEDRLTHIMDKFEQVDTSATRRHEGTGLGLAISKRLISMYNGELCVRSDFGNGSCFSFSLQLPKRSQPHSEPVELNANRLLLIDDYQPRVEHLMRLAKEIGIEVTHRNDWSAAQSLGRDLDDFDRIIASVNNAQDRDALYELDATESAAKRVLFLAPCVMEEGQAWSCERDRLLPQPVTQHKLQTLLSSKIQKRRALSSQDNPDFSNLHLLVAEDSHINRILIEKMLQDTGVKLTLAEDGVEAVELYKQLSPDLVITDISMPNKDGFGVTKDIRELQENGEFPWCPIVAFSAHAMQEEQQKSIALGMNDYLTKPVQKSDLLDMIAKWGRHTQMAEKHASG

SEQ ID NO: 9801 - protein, 360 aa, Corynebacterium glutamicum
MSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 9802 - protein, 186 aa, Zea mays
MSVGTLPESATNRPRAPAPPEAQEEEVAIRNKQSIPPNPQSPIPNPQTLGYLGAAAMAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDIKKKEDEITRLQEKYGIGSKTPGPGSSD

SEQ ID NO: 9803 - protein, 322 aa, Ustilago maydis
MSKVTASGIISGNISTQRIKLNNGQEIPQVALGVYKAPNDGSTENACKWAFDAGYRHIDSAARYMNEESVGRALAEWTKENNVPRSEIFITSKLWDADHDKAAAAIEDSLKKLNVDYMDMYLMHSPGTMGAEKRLEAWKALEEAVDAGKIKTIGVSNFDVEELDHLLANCRIKPAVNQIESHPFFAHEELREACISRGIHIQAYSPMAQGQALDRPEIKTIASKHGKTPAQILLKWGLTHGNIILPKSLTKHRIESNAQLFDFELDSDDMDVLDNLDEGMKVGKLGPAGTSQPASPGGTRPGSRRSSGSGGLSGNKLQMSSS

SEQ ID NO: 9804 - protein, 629 aa, Desulfovibrio desulfuricans
MCGIAGYCGACGVADTTEKECAGRLEALLAGIVHRGPDDAGITCAHNVAIGMRRLSIIDLAGGHQPMLSGDGRYALVFNGEIYNFRELRSELAEAGYSFATNSDSEVLLKGYMAWGRGVLDRLDGMFAFAVHDRHAGTVFLARDHLGIKPLYYIHLGGVFAFCSEPAPLLELPQVRRRLDHDALAAFLSFKYVPAPDTFIKDIKKLAAGHTLEYSPRGDMLRTERYWQLQGREGSSDAGELAERLTRAVDSQMVSDVPLGVFLSGGIDSGLLTWAAAGQGGEHFTGGYTVAFDETGRKKGLRAGGSFDESRLAALSAAHLGVPLSSTTLASPAQATLDDWIRRFQEPFANTSIPANFLLCQWVARHVKVALNGSGADELFGGYDRYYAVHPPAALRALHCAAPLLRRVADMLPVGGGKNSLVHRARRYLAGCALAPAQKHAGSIRLFTDTQLAAIAPGVVPATFVQDAFAGAPQGSLLYKATWTDMQTMLPDDYLTLVDRTSMAASLEVRVPFLARDFVQYAFSLPPAAKIAGWKKKTALRALAAKHLPEDIARQPKMGFESPVGRWFRDGLGEALCRQLAQSPLQNIISVRGVQALAQSHSAGQVDAAKPLLALYTLVRWMDMYRVEL

SEQ ID NO: 9805 - protein, 344 aa, Synechococcus elongatus
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 9806 - protein, 330 aa, Candida albicans
MSNNIEDDSISVDNIVDRLLEVRGSRPGKQVTLTENEIRFLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRFNIKLWKTFTDCFNCLPIAAIIDEKIFTMHGGLSPDLNSMEQIRRVMRPTDIPDVGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPADKKPRYAPANVANNRPGANQRKPKKAVK

SEQ ID NO: 9807 - protein, 143 aa, Glycine max
  misc_feature (97)..(97): Xaa can be any naturally occurring amino acid
  misc_feature (140)..(140): Xaa can be any naturally occurring amino acid
MGCVHFESADQRTLSVQEKLNDKTSSTVLQEHEEQGGIQEAWSEIKNRGENVGGYLAGESRHKLEKKKSQVLLEGYVEAQDDQEDLTRAKSLTDDDXLEELKGCLDLGFGFSYDEIPELCNTLPALELCYSMSQKFLDDXAKP

SEQ ID NO: 9808 - protein, 436 aa, Pseudomonas aeruginosa
MLHCFRPTTLALALLLGAGAAQAADAPADAAPLANGSSAPLPLDELRTFAEVLDRVKAAYVEPVDDKTLLENAIKGMLSNLDPHSAYLGPEDFAELQESTSGEFGGLGIEVGSEDGFIKVVSPIDDTPAARAGIQPGDLIVQIDGKPTKGQSMTEAVDSMRGKAGSPITLTIVRDGGRPFDVELKRAIIKVKSVKSQVLEPGYAYLRITQFQVNTGEEVVKALNQLRKDNKGRLKGLVLDLRNNPGGVLQSAVEVADAFLTKGLIVYTKGRIANSELRFSADPADPSDKVPLVVLINGGSASAAEIVAGALQDQKRAILMGTDSFGKGSVQTVLPLNNDRALKLTTALYYTPNGRSIQAQGIVPDIEVGRAKVTQERSSFEGFKEADLQGHLANGNGGADRPTGKRAAPSERPQDSDYQLSQALSLLKGLSVTRGN

SEQ ID NO: 9809 - protein, 1479 aa, Burkholderia fungorum
MRRALERVRLCLLAWCLIAAAQTATAAQLFDNRSNSQVVAAFPAKLTVGVLAGGWLPLDALQDGRLTGMSVDYLRALVGPNVVIEAKAFPDVSQLLAAACAGNVDLLTSVARTPERERCLSFTAPYFRSSSSAVVRRDGDSYASPALIAGARIAVEKGFALERVARERFPHAQISAFATTHAALSAVVRGDADVYLGFTPAVQYALATEEFRGLHVAFEESSRTANLRFAVPRSHAALRDQLDEALASMNPADEAAIRVRWLSGNFDAKPVPTAPRLVLTPQEQAWLRSLPPLQIGFDNGWSPFSYVDSSGRPAGIAADYLAYLSRTLGVVFNRARTADWPTAIESFQRGELAILATASIHDPRLKGARHTVAYESYPLVIVGREDEPAARSLSDFASRRVVVSSHVAGSIPLAFERIPADHVVIAPSLDDALDMVAAGEADVLVGNVAAIDILLKQRYDSVLKILGTVGESDALDFAVRTDLSPLAGLIDRALLAMPPAEKQRIRQKWVTGNSPESGLWSVTAVRLLPLLIGIGVALLITLRAYLLLQREVRLRKKTELELELQLNFQETMMKMVPYPLVAIDLDGRYIAVNEAYEQACGMSREAVIGRNTVDVQTWGEANSRILTDMTREMLNGRETAQLELQFERGAGNVRHGLFWASVCRDGDGQPACVLGTVVDITDIRRAEMRARETERRLFDVTRSLPAVVFQLRRTSDGAYSFPYIGGDTRHLLGGKDGSLNRSDHVDFQRVCEEDRAFVLAELERSALCETPVNMEFRFEGDEEIKWARAELVPRREADDSVVWSGYWVDASVEHARSDELARARDLAEAAARAKDDFFAMMSHEIRTPMNGVLGLVEVLERTPLNTDQGEMLGMIHESAGALLQILDDLLDYSKIEAGRLTIEAESIDIRELVDNAVGLLAGRAHEKGLKVRVDIAPDVAATLRGDSVRLRQILFNLLGNAIKFTPQGEVDVRVSVFAQADGVQTLEMTVEDTGIGIAPEVQNRLFEPFVQAESSTTRRFGGTGLGLTICRKLIDLMGGSLALHSEPGSGTRMTVRLDMAVETQRYSVNGLRGKRGLVATGDARVAQALMHFGEALGLTLRRVPPDAPELRDRVALANLDLLFVNEDVTLPADVRPRTRVICLTEKPKPTGYRILDDNVRLSINPISWRGLGAACAAAMTGLPSVPRSAGTPRAPEGGPPPPDRERAIASGRLILVAEDHPVNQELIRHQLALLGFACDVTNDGAEALAALQRTSYGCLITDCHMPNVSGYELTRRIREGEEGGAHRLPILGITANTAPEDLNLCRDAGMDDSLVKPTRLATLRDYLSRWFGSDSAAHAAPSESVGAPAIAATDVQGGADPFVPVDLGHMTQLWGSESTVKALLDSFVSSVREDVQSLSPLLERVGSERTELERVREWLHRVAGAASVLQYPPLLMALEDYRREINVKPPERVRNDGMVLIDKCNAMLDGIEQQAALLV

SEQ ID NO: 9810 - protein, 672 aa, Salmonella typhimurium
MSYPSLFAPLDLGFTTLRNRVLMGSMHTGLEEHPDGAERLAAFYAERARHGVALIVTGGIAPVPSGVVMTGGAMLNDASQLTPHRVVTDAVHAQGGKIALQILHTGRYSYQPHLVAPSAIQAPINRFMPHELTHDEILQLIDDFAHCAQLAREAGYDGVEVMGSEGYLINEFLTRRTNHRDDEWGGDYASRMRFAVEVVRAVRQRVGNDFIIIYRLSMLDLVENGGTFDETVQLAQAIEAAGASLINTGIGWHEARIPTIATPVPRGAFSWVTRKLKGHVSVPLIATNRINDPQVAETILTRGDADMVSMARPFLADAEFLTKAQSGRADEINTCIGCNQACLDRIFIGKVTSCLVNPRACHETHMPITPAIRKKNLAVVGAGPAGLAFAINAASRGHHVTLFDAQSEIGGQFTIARQIPGKEEFYETLRYYRRMIDVTGVTLKLNQRVNAEDLQPFDEAILACGIVPRRPPIDGIDHPKALTYLEVLRDKAPVGKRVAIIGCGGIGFDTAMYLSQHGESTSQNIAEFCTEWGIDTSLQQAGGLRPEGPRLARSPRQIVMLQRKTSKPGEGLGKTTGWIHRATLLARGVKMIPAVSYQKIDDDGLHLLIGGEPQLLEVDHVVICAGQEPRRELADPLRAAGKTVHLIGGCDVAMELDARRAIAQGTRLALEI

SEQ ID NO: 9811 - protein, 564 aa, Triticum aestivum
MALLAAATLNPTTHLSLRSRAGRNSENLWLRSAASSQKSKGRFCNLTVRAGTPSKPAEPIGPVFTKLKPWQIPKRDWFDKDFLFGASTSAYQIEGAWNEDGKGPSTWDHFCHKYPERISDGTNGDVAADSYHLYEEDVKALKDMGMKVYRFSISWSRILPNGTGEVNQAGIDYYNKLINSLISHDIVPYVTIWHWDTPQALEDKYGGFLDLQIVDDYKQFAKVCFESFGDRVKNWSTFNEPHTYCCFSYGEGIHAPGRCSPGMDCAVPEGDSLREPYTAGHHILLAHAEAVEMFRTHYNMHGDSKIGMAFDVMGYEPYQDSFLDDQARERSIDYNLGWFLEPVVRGDYPFSMRSLIGDRLPVFTKEEQEKLASSCDIMGLNYYTSRFSKHVDISPDVTPKLNTDDAYASSETTGSDGNDIGPITGTYWIYMYPKGLTDLLLIMKEKYGNPPIFITENGIADVDGDETMPDPLDDWKRLDYLQRHISAVKDAIDQGADVRGHFTWGLIDNFEWGSGYSSRFGLVYIDKNDGFKRKLKKSAKWFAKFNAVPKHLLGYYQANWATPV

SEQ ID NO: 9812 - protein, 366 aa, Unknown
  Populus tremula x Populus tremuloides
QMGLAENQLCFDLIQDWLKKNPKASICSPEGLNEFREIAIFQDYHGLPEFRSAVANFMEKVRGNRVTFDPDRIVMSGGATGAHETVAFCLADPGEAFLVPAPYYPGFDRDLRWRTGVKLIPVDSDSSNSFMVTREALENAYEKAQLDNIKVKGLLITNPSNPLGTILDRETLRSIVRFINEKNIHLVCDEIYAATVFSQPDFISVAEILQEDIECNLDLVHIVYSLSKDMGFPGLRVGIIYSYNDAVVSCARKMSSFGLVSTQTQYLIASMLSDNEFVEMFIRESKSRLAARYRVFTRGLDQVGIECLKTSNAGLFLWMDLSRLLKEQTFKAEMGLWRVIIHEVKLNVSPGCSFHCSKPGWFRVCF

SEQ ID NO: 9813 - protein, 581 aa, Oryza sativa
MYRAAAAAASSISRSSSALRKQLSRGGCGEQRLWARGYAAKEVAFGVGARAALLQGVNDLADAVKVTMGPKGRNVIIERSHRAPKVTKDGVTVAKSIEFEDSAKNVGANLVKQVAEATNKVAGDGTTCATVLTQAILTEGCKAVAAGVNVMDLRNGINKAISSITTHLKSKAWIINSSEEINQVATISANGEKEIGDLISKAMEKVGKDGVITITDGKTLDNELEAVQGMKLSRGYISPYFVTDQKTQKCEMENPLILIHDKKISTMNSLLPVLEMSIKNRRPLLIIAEDVEGEALSMLVLNKHRAGLKICAVKAPGFGENRRANLDDVAVLTGGEVVSEDQGLDLGKVELQMLGTAKKVTVSLDDTIILDGGGDKQQIEERCQQLRESMDKSTAVFDKEKAQERLSKLSGGVAVLKIGGASEVEVGEKKDRVTDALHAARAAVEEGIVPGGGVALLYATKELDKIITANEDEKIGVQIIKNALKAPLMTIAANAGIDGGVVIGKLIEQDNLNMGYDAARGEYVDMIKAGIIDPVKVIRTALQDASSVSLLMTTTEAAVAEPPAAKARMASRMPQMSGMDF

SEQ ID NO: 9814 - protein, 413 aa, Triticum aestivum
MSVSSSSMCGGDAGMKCVVWFRRDLRVEDNPALAAAARTAGEVVPAYVWSPEEDGPYFPGRVSRWWLSQSLKHLEASLHRLGAAKLVTRRSPDSVAALLQLVRDTGATHLFFNHLYDPISLVRDHRLKEMMTAEGIVVQSFNADLLYDPWEVNDDKGQPFNMFMPFWNRCLSMPYDPPAPLLPPKRINSGDLSMCPSDDLIFEDESERGSNALLARAWSPGWQNADKALSAFLNGPLIDYSVNRKKADSANTSLLSPYLHFGELSVRKVFHLVRMKQLVWSNEGNHAAEESCTLFLRSVGLREYSRYLCFNHPCSHEKPLLAHLRFFPWVVDESTFKFWRQGRTGYPLVDAGMRELWATGWLHDRIRVVVSSFFVKVLQLPWRWGMKYFWDTLLDADLESDALGWQYLGRDHA

SEQ ID NO: 9815 - protein, 365 aa, Unknown
  Populus tremula x Populus tremuloides
QMGLAENQLSVDSIIDWIEKHPEASICNPEGVHMFKDIANFQDYHGLPEFRQAIAKFMGRVRGGRVAFDPDRIVMSGGATGANELIMFCLADPGDAFLVPSPYYPAFYRDLGWRTGVQIVPVDCDSSNNFQITKGALEAAYDKAQQNGINVKGLIITNPSNPLGTTLDRETLKSLLSFINEKNIHIVCDEIYAATIFGSENFVSISEVVEEVMDCNRDLIHIVYSLSKDMGLPGFRVGIVYSYNDAVVNCGRKMSSFGLVSSQTQYLLASMLSDEEFVEDFLAGSSKRLKKRHGVFTKGLEQIGISCLESKAGLFVWMNLRHLLKEQTNDGEMALWRVIVNDVKLNVSPGSSFHCVEPGWFSVSS

SEQ ID NO: 9816 - protein, 127 aa, Brassica napus
MAGMVFGLEAPMMTALQHLLDIPDGEAGAPAGEKQGPTRAYVRDARAMAATPADVKELPGAYAFVVDMPGLGSGDIQVQVEDERVLVISGERRREEKEDAKYLPMERRMGKLMRKFVLPGNADMEKI

SEQ ID NO: 9817 - protein, 480 aa, Listeria monocytogenes
MKELLTFPKNFWWGSAWSAEQAEGRGDTGKAKTVWEHWFETEPNRFYEGVGSEITTDHFNRYKEDVQWMKKTGQNSFRISISWARMFPNDGVGEVNPKAIAFYRDLLTEMNENGIKPFANLYHFDMPVALQDAGGWESREVVDAYVHFADTCFKEFGDLVYHWFTFNEPLGPILGGYLEDFHYPNQIDFKRGAQAGFNTILAHALAIKAFKKLNLSSKIGVILNLSPTYPRSQNEYDLEAAEICDAFYTRSFLDPMVKGTFPEKLVEIMREYDQMPEYTEEDLTIIKENTAQILGLNYYEPRRVKARLTAINEKSPFLPDWFFEPHNMPGKRMNIYRGWEIYERGIYDLCIDIRDNYGNIESFISENGMGVANEERFLNEEGQIQDDYRIQFVKDHLAYVHQAIAEGCDIKGYHLWTFIDCWSWINAYKNRYGLVSLDVETGKRTMKKSGEFYKKMSDMNGFEYDTSKLVGTKREETTNG

SEQ ID NO: 9818 - protein, 299 aa, Arabidopsis thaliana
MSETTKDDGSSQKKSVRKEKRAYVLRKWTQFDVGRASTVGTVHLLCLLAPFNYKWEAFRFGIILAILTNLCITFSYHRNLTHRSFKLPKWLEYPFAYSALLALQGDPLDWVSIHRFHHQFTDSDRDPHSPIEGFWFSHVLWIFDTDYIREKCGRRNNVMDLKQQWFYRFLKKTLVLHILAFWTLIYLWGGLPYLTWTVGFGGVIGYHGTWLVNSACHICGSQAWQTNDTSRNVWWLALLTMGESWHNNHHAFETSARHGLEWYQLDITWYLIWFFQALGLATNVKLPTDAQKRKMAIRR

SEQ ID NO: 9819 - protein, 168 aa, Triticum aestivum
GRIEKWVLRNAFDDEEKPYLPKHILYRQKEQFSDGVGYSWIDGLKDHAKAHVSDSMMTNASFVYPDNTPTTKEAYYYRTVFEKFYPKNAARLTVPGGPSIACSTAKAVEWDAAWSELLDPSGRAALGVHDAAYEEKAPASVDPVVDNVSRSPAHDVKRLKTAISAAAV

SEQ ID NO: 9820 - protein, 323 aa, Allochromatium vinosum
MDPIRTSRLRAPLLASALLLAGSSVCAAEPDLETELRLNAMIGDTETAAELLDQGAHVDAPNQFGKTALMFAVEGDDLETVALLLSRGADVNARTVAGCTPLTFAAEAGHIGISALLLERGAHVHDRTRSGWDALMIASRHGITDMVEQLLFKGADPKAADREGRTALMQAASKGETGVLPLLIEGGADLEARDKQGATALLIAADQGQAGAVETLAGLGAQLDAVDALGSTALILAVGHGHVAMVERLLAMGADPNRQDRKGTTALMEAVATDHAELIDRLIAAGARTDLKDDADRTAADIAVQLGHRQAIARLAPKASKTP

SEQ ID NO: 9821 - protein, 435 aa, Arabidopsis thaliana
MGSWIPKLLLLQLVLLLTKHADSSSIIKYLPGFEGPLPFELETGYIGVGEEDEDQMFYYFIKSESNPKTDPLLLWLSGGPGCSSFTGLIYENGPLGFKVEAYNGSIPTLVSTTYSWTKVANIIYLDQPVGTGFSYSRNPLADIPSDTGSAKRVDEFLRKWLTKHPEYFSNPFYAGGNSYSGKMVPVIVQEISNGNCIYGKPQIRLQGYVLGSPVTDYDLDRNSRIQFAHGMALISNELYESMKRTCGGNYIFVDPLNTECLELIKDYDNCVSGIYENLILVPKCDLTSPDCHSYRSMLSDYWANNESVRRALKVVEGTTGRWERCKWTLQNNKDIKSSIPYHKKNSIQGYRSLIFSGDHDMLTPYVGTQDWIRSLNYSIIDKWRPWMILDQVAGYTTTYANKMTFATVKGGGHTLDYKPDENSILFKRWISGQLL

SEQ ID NO: 9822 - protein, 224 aa, Glycine max
MGSEGPPAAVATVHVTGFRKFHGVSENPTETIVNNLNEYLNKKKGLPKGLVIGSCSILETAGQGALIPLYQTLKSAITSKESESSSSNKIIWLHFGVNSAATRFAIERQAVNEATFRCPDEMGWKPQKVPIVPSDGAITRIRETTLLPVEEITKALANKGYDVMTSDDAGRFVCNYVYYHSLRFAEQNGTKSLFVHVPLFSTINEETQMQFAASLLEVLASTCQ

SEQ ID NO: 9823 - protein, 172 aa, Triticum aestivum
SQYYVLIRLGRSGFKKIMSNLTATADHLADRLKATGRFEIMSEGQGRGLPLVAFRLKDEHHYNEFDISSKLREGGWIVPAYTMAPNVEHIKMLRVVVREDFSRSRCEILVKDIIAALRALDTSDKEAVAKRREHIEEHSHSSIYSNDVNPKSKTTGTESESTEDSKTAQGIC

SEQ ID NO: 9824 - protein, 130 aa, Oryza sativa
MAAVSLRKSNARLPPEVNRVLYVRNLPFNISSEEMYDIFGKYGAIRQIRLGNAKDTRGTAFVVYEDIYDAKNAVDHLSGFNVANRYLIVLYYQPAKMSKKSDVKKKEEEITRLQEKYGLGSKTPSSAPDA

SEQ ID NO: 9825 - protein, 413 aa, Bifidobacterium longum
MDISAPNPIAAAEAAAKANGIALSKLNDSNPTRHGLAPELVPSVYTADPRGPRAARESLAAFLNTANVVDASSPQLASPAAGEGRNERHAAFTNVNTAIEGADPDALYLLSSTSEAYSWLIKLLCDAGDAVLAPKPGYPLIESIARLECVDTVEYQLQFDGSWFIDIAELERLLSEPGGERVRALVLINPNNPTGSYVKPTERARIVTLCREHGIALIADEVFFDYSLEPFPGDARLAGERGVLTFALDGFSKMLAAPHAKVGWIQVSGPAEDVAEAQRRLDVIADDYLPMGDIIAERIPALLNAAPAQTRRVGERVRNNLAKLHELLDADPNGLVSVLRAEGGWNVLLRVPSVIDENELVLRLIDEHQLTGQPGYFFDMTSNGYLAVSLLPEPDEFERGIRAVLNTVAALLR

SEQ ID NO: 9826 - protein, 409 aa, Magnaporthe grisea
MGSAGPANPKLFEPLAIANGKHVLKHRVVHAPLTRNRGTPVNKNDSREEPNRLWLANDVIKEYYTQRATDGGLIISEGLPPSLEGGAMPGVPAIHQAAQVESWKPVTEAVHAKGSIFYAQLWHSGRAMIPQHIGGPVPAPSAVPWDDPTEVFWYPPAHTTELCKYVDYPPIEMTVEHIKRTIDDYVKAAKNALEAGFDGIEVHGGNGYLPEQFLSSNSNQRTDDYGGSPEKRCRFVLELVEALAAAIGQENLAIRLSPFGLFNQARGTQRKETWGYLCRELKARLPNLSYVSFIEPRYEQLFSEEDKQKFLDDWGMSNVDLSMFREIFAGTPFFSAGGFDAKTGKEAVEKGTYDAIVYGRYFTSNPDLVRRVKEDLPFNPYNRERFYGPFEDPTIGYTDFATYDEQQKK

SEQ ID NO: 9827 - protein, 299 aa, Arabidopsis thaliana
MCDPIREDGSNKRGAVSKEKRPYIHREWSWADIIRALTVINVHFLCLLAPFNYKWEALRFGFVLYALTSLSITFSYHRNLAHRSFKLPKWLEYPLAYFAVFALQGDPLDWVSIHRFHHQFTDSDRDPHSPIEGFWFSHVWWICDTRYIKYKCGGRNNVMDLKQQWFYWFLRMTIGFHVLMFWTVLYLYGGLPYLTCGGGVGGVIGYHVTWLVNSACHIWGSRSWKTKDTSRNVWWLSLFTMGESWHNNHHAFESSARQGLEWWQIDITWYLIRLFEVLGLATDVKLPSEIQKQKLALTR

SEQ ID NO: 9828 - protein, 466 aa, Bacillus subtilis
MKRQLKLFFIVLITAVVASALTLFITGNSSILGQKSASTGDSKFDKLNKAYEQIKSDYYQKTDDDKLVDGAIKGMIQSLDDPYSTYMDQEQAKSFDETISASFEGIGAQVEEKDGEILIVSPIKGSPAEKAGIKPRDQIIKVNGKSVKGMNVNEAVALIRGKKGTKVKLELNRAGVGNIDLSIKRDTIPVETVYSEMKDNNIGEIQITSFSETTAKELTDAIDSLEKKGAKGYILDLRGNPGGLMEQAITMSNLFIDKGKNIMQVEYKNGSKEVMKAEKERKVTKPTVVLVNDGTASRSRNYGRCLHESSNVPLIGETTFGKGTVQTAKEYDDGSTVKLTVAKWLTADGEWIHKKGIKPQVKAELPDYAKLPYLDADKTYKSGDTGTNVKVAQKMLKALGYKVKVNSMYDQDFVSVVKQFQKKEKLNETGILTGDTTTKLMIELQKKLSDNDTQMEKAIETLKKEM

SEQ ID NO: 9829 - protein, 436 aa, Oryza sativa
MGFVESIGRYRVGRTIGAGTFAKVRLAVDADTGATVAVKVIDKRMVIRNNLMYQVKREITAMKLLNHPNIVKIYEVIATKTKICLVMEYVSGGQLSDKLSYLKRLDEKEAKKYFYQLIDAVDYCHRRGVYHRDLKPENLLVDNQGNLKVSDFGLSVLKKPGQFLSTSCGSPCYVAPEVIQHKSYDGAAADVWSCGVILFELLAGYLPFQDCSLTNLYRRISRAQFVFPQWLSVPQKKIIIRILDPSPITRAKISDIFDDKWLQDHCNPSARIENDDDCDVIEEASTDSDSSHNTEVKETEEMTAETDRFINAFQLIARCSDLDLSGLFQEQKTKLASPHPVQETFDKIKVAAKDVSMAVKRMNSSLVEIQDSKLLPRSNLDLTLSAEVIKVTPAHCVVEVSKSTGDLRSYKEFCRSLSSLLNGGQLSASSSDMECD

SEQ ID NO: 9830 - protein, 273 aa, Lactobacillus johnsonii
MKHLTLNNGVKIPIFGFGTYEISPDQTKEAVLSAFKDGYRLIDTAQYYQNEQQVGEAVRASNLNRDEVFITTKTMTDGYEATKQGLDESLNKSGLDYFDLVLIHWPMGHDLDTWRALEEAYKAGKTRAIGISNFNSRQTLELINHAEIRPMVDQIETHLLLQQWKMHEFLKKENIIHESYSPLGNGQQNLMTNPVLQKIGEKYGKSPIQVILRYLVQNDIVTIPRSTNPAHIKANIDIFDFELDKEDLKQLCALDERKPIDGWPAEMREDEDY

SEQ ID NO: 9831 - protein, 221 aa, Ginkgo biloba
MGRGKIEMKRIENTTNRQVTFCKRRNGLLKKAYELSVLCDAEVALIVFSSRGRLYEFANNSVKRTIDRYKKTCADNSHGGAISECNSQYWQQEAGKLRQQIDILQNANRHLMGDALTSLSVKELKQLEIRLERGISRVRSKKNEMLLEEIEIMQRREHILLAENQFLRTKIAECESSQNANMLPGPEFDALPGFDSRHFLHASIMDAHHYAQQDQTALQLG

SEQ ID NO: 9832 - protein, 706 aa, Mycobacterium avium
MATDHTSDAPDPKQRDLESARFRRDTGYLTTQQGVRVDHTDDALTVGERGPTLLEDFHAREKITHFDHERIPERVVHARGAGAYGYFEPYDDRLAQYTAAKFLTSPGTRTPVFVRFSTVAGSRGSADTVRDVRGFATKFYTEQGNYDLVGNNFPVFFIQDGIKFPVLVHAVKPEPHNEIPQAQSAHDTLWDFVSLQPETLHAIMWLMSDRALPRSYRMMQGFGVHTFRLVNARGRGTFVKFHWKPRLGVHSLIWDECQKIAGKDPDYNRRDLWEAIESGQYPEWELGVQLVAEDDEFSFDFDLLDATKIIPEEQVPVLPVGKMVLNRNPDNFFAETEQVAFHTANVVPGIDFTNDPLLQFRNFSYLDTQLIRLGGPNFAQLPVNRPVAQVRTNQHDGYAQHAIPQGRSSYFKNSIGGGCPALADEDVFRHYTQRVDGQTIGKRAEAFQNHYGQARMFFKSMSPVEAEHIVAAFAFELGKVEMPEIRSAVVAQLARVDDQLAAQVAAKLGLPEPPEEQVDESAPVSPALSQVTDGGDTIASRRIAVLAADGVDVVGTQRFTELMEQRGAVVEVLAPVAGGTLAGGSGGELRVDRSFTTMASVLYDAVVVACGPRSVSTLSDDGYAVHFVTEAYKHLKPIGAYGAGVDLLRKAGIDNRLAEDTDVLNDQAVVTTKAAADELPERFAEEFAAALAQHRCWQRRTDAVPA

SEQ ID NO: 9833 - protein, 159 aa, Glycine max
MRVAATRPASSAPVALLAALALLFLVGSASLAIGAMASHVLGGKSENPAAANSLETDGLARFAVDEHNKRENALLEFVRVVEAKEQTVAGTLHHLTLEALEAGRKKVYEAKVWVKPWLDFKELQEFRHTGDATSFHHLRTSAPREGEHDPGMAGCGPVQ

SEQ ID NO: 9834 - protein, 705 aa, Cytophaga hutchinsonii
MIGFILSRIQLIVLLLLTFVAIPASAQTSKTEQPSCSKKTDALWVLLTKKHIAPIQFNHTVSVEIADLLLTELDYKKIHFYESDRQNLLIQIQNLKPSSAKDLCTLIAGISELYQTRIKESQAILQTLAANELNFSENEIVTFSSSKRQFMESKEKKISRWKRNIKFLVLNNLYYAVDSAHSTDVAAPSNFLADKNKITRTIIDKELKKINALADPSTDFTATVENALLNAICKRFDPHTEYYNYTAFKEFSEHLQSKVLTFGVFFGETAFGNLSIRYVAPGSTAWFSNVIQENDVVLWFKLNQQVFDVSALTHTEANALLQNEKYSLLEIGLKKDNGSSETIKLKREAIKFENNTVKSYIIKDAKKIGYISIPSFYSDDSNPNALGAANELSKEILKLKNENIEGLIIDLRNNGGGSLYEAVGMSGLFIDIGPLFYVLERSGKATLTKDMNRGTVYDGPLCIMVNGYSASASEIFSAAMQDNHRALIVGEQTYGKATGQSISQLDTTKSISTFSATDNMGATKITEIKLYRTSGFSYQGKGVTPDIILPYLDVLSEKENTEPFYLKGDSIAKKAVFAFPEALPVASLNEMNNIRIKENPQYKQLKHVSDSLHTTQDDDIIIHLTAAGFWKDMRILKAENEKESAAGSFVRPGFEVYYNRLESDFLSYDANYKKLYTGYLDELKTDLILQQTHDIMCDFIKLKQK

SEQ ID NO: 9835 - protein, 612 aa, Arabidopsis thaliana
MKMDKKTIVWFRRDLRIEDNPALAAAAHEGSVFPVFIWCPEEEGQFYPGRASRWWMKQSLAHLSQSLKALGSDLTLIQTHNTISAILDCIRVTGPTKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSVVRYNGSKRVKPEEEEERDMKKSRGFDERELFSTAESSSSSSVFFVSQSCSLASEGKNLEGIQDSSDQITTSLGKNGCK

SEQ ID NO: 9836 - protein, 547 aa, Haemophilus somnus
MTAKDVKFGNDARVKMLAGVNVLADAVKVTLGPKGRNVILDKAFGAPTITKDGVSVAREIELEDKFENMGAQMVKEVASKANDAAGDGTTTATVLAQAIVSEGLKAVAAGMNPMDLKRGIDKAVNAVVEELKILSKPCETSKEIEQVGTISANADETVGKLIAQAMEKVGKEGVITVEDGSGLSDELDVVEGMQFDRGYLSPYFINKPEAATVELDNPFILLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEEATSDYDKEKLQERVAKLAGGVAVIKVGAATEVEMKEKKDRVDDALHATRAAVEEGIVAGGGVALIRAATKVATTLKGDNEDQDVGIKLALRAMEAPLRQIVTNAGEEASVVASAVKNGEGNFGYNAGTEQYGDMIAMGILDPTKVTRSALQFAASIAGLMVTTECMVADLPKEEKADLTGGMGGMGGMGGMM

SEQ ID NO: 9837 - protein, 649 aa, Rhodococcus erythropolis
MTPYPRLFAPLRLGNLTLRNRVVFSAHLTNYAENGLPTEQHASYYEARARGGAGLIITEEHSTHPSDRPYEKMIAGYRPEAIEGYRRITDAVHAHGSSILAQINHNGGQGAGTYSRSPLLAPSAVADPLFREVPKAVDDADIAEILAGFALVARNCVAGGFDGVELQASQSSIVRAFLAPSTNLRTDRYGGGVANRARFLLEVLGVLRKAIGPDRVLGVRLSGYEGTRGGIELSDAVTTAQLIEADGHVDYINTTVGMATETLHLVEASMAVPTGYANFVPSAIREVIDLPVVGVGRFKTPEQAEAALEDGVCDLVGVVRGQIADPDFVNKARAGQSSQVRTCLSCNQECVGRMGLGRWLGCTENPRAGRESVPLPMPRRRGRTVVVVGGGPAGLQAAATAAQRGHAVTLFERERRLGGQILTASVVSVRRELADLVRNLESECRRSGVTIELGVGADLAIVEERAPDVVVIATGARPVRPTWAGGSERVVSVRDVLDGRVLPSGMVLVYDELGFHQGTSVAEFLADRGCAVTIATNGMVVAQDLSVTLDFEGWNRRAFEKSIVQRTDLMATSVSAGASPLVSLVHLPTGVVEEVAVDWVVFATQQEPVDELWNTLQGSSFEIFRIGDALSPRRSHAAVIEGHRAALAI

SEQ ID NO: 9838 - protein, 142 aa, Streptococcus thermophilus
MLNKIQHRNLNTYSVTPFDFFEEFSRNLFNDFKPNFIKTDIHETDNEYLVEAELPGIPKENIQVTYENGVLTISGQRQIDAVNEDKKGKLIRSERSLTSVQRQYLLENVKEDEIKASYSDGVLKVTLPKDSNKEIKKSISIE

SEQ ID NO: 9839 - protein, 668 aa, Porphyromonas gingivalis
MRIIEQDPWLRPYESVIESRLKYARKRETDLTGGRSGGLSDFANGHLYYGLHQDGDSWVIREFAPEATAVYLIGELSRWRRLPQFRFAPVDEAGSWELRLSCRLLPHGSRYRLFFEWPGGEGERIPAWCNRVEQDPETYLFYAQVWVPDTPYEMKHPHPNRKDEPLLIYECHIGMSSEEEKVSTYEEFRRNILPRICKDGYNAIQLMAIQEHPYYASFGYHVSSFFAPSSRFGTPEDLKRLIDEAHALGLYVIMDLVHSHAVKNEVEGLGLYDGTHTLFFHDGNRGLHPAWDSYCFDYGRDNVLHFLLSNCKYWLTEFGFDGFRFDGVTSMLYYSHGLGDRFDNYDSYYNGHQDGDAIAYLILANKLIHELCPDAITIAEEVSGMPGLALPLADGGYGFDYRLAMNIPDFWIKLIKEHRDEDWNPGDIWYQLTNRRQEEKTISYAESHDQALVGDKTIIFRLIDADMYWYMNKQSCVHSVDRGIALLKMIRLFTATTMNGGYLNFMGNEFGHPEWIDFPREGNGWSYKYARRQWSLADSPFLRYAGLHLFDQDMIAMIRSVESFHKLPLREYWLKREEQVICYGRGDFFFVFNFHPERSYSDYPIPLPAGKYSVAMSTDARKYEGFGRVDEWVEHFTLPDGSKDRFTHEQYLNLYLPARSALVLKLAE

SEQ ID NO: 9840 - protein, 653 aa, Oryza sativa
MPYNESERLDILKRYSNMLEALPGYAFDDATSLVSYICGVPIAYIAFIDENRQWFKSEIGLGFSIVPREITFSRYTIMDSSLVEIQDTLLNERFKDDPDVKGGLKIRFYAGMPLITPDGHAVGVLCAADHEPRSLNENQKRALHIVARHVITTLELGIKNNELLRQKKIAESAVLAKESFLANMSHEIRTPLNAIIGFTELLSGTPLDKQQQAFIQDVQTAGENLLLIVNDILDLSKIESGGLSLEKQPFNLKKSLRHVYDLLKVKTADGVEFNLYLDAELPDVITGDQGRLNQIMVNLAGNALKFTNEGEVTISVKNKGETEDSYTIRFSVKDTGIGIPKEHLESIFERFTQGQEDTTRKFGGTGLGLSIVKELVKLHDSKIQVKSREGAGSEFFFTTTYKKPANVKENPKLLPVNDLGRLKILLLEDNRLNQKLAQNVIEGFGFEIDIAENGDQGIKLLSENQYDLVLMDLQMPARDGYQTTHYIRSELKNEIPIIAMTAHSLADEHHRCLNAGMDGYVPKPFKQHELLEAIKQALKKDRRPLIPSKADLSAIEKTDRIKPGWKKEVTSQFIQKAPVELKELQQAVYRKDFRSVLQTAEQLQVWLHLFLLENLSQTLTSIEDQARKKEFTAETADNLDILHSNIEEIIKEL

SEQ ID NO: 9841 - protein, 738 aa, Burkholderia fungorum
MSSQVNYSTRIAEGTPFPLGATWNGSGVNFALFSAHATKVELCLFDETGENEIERIELPEYTDEVWHVFVPNLKPGAVYGYRVHGPYEPEKGHRFNPNKLLLDPYAKAHIGELKWAPEIFGYTLDSEEGDLSFDERDSAPFVPKCKVVDANFSWSHPERNALPWERVIFYEAHVRGFTKRHPEVPENLRGTFAGLGQQVVLDYIKNLGVTSVELMPIQTFVNDSYLLDKGLTNYWGYNTIGFFAADPRFFASSIDSVGEFKEMVDRFHNANLEVILDVVYNHTAEGNERGPTISFKGIDNASYYRLMPDEPRYYINDTGTGNTLNLSHPRVLQMVTDSLRYWVTEMKVDGFRFDLATILGRELHGFDEGGGFLDSCRQDPVLSSVRLVAEPWDCGPGGYQVGGFPPGWAEWNDRFRDTVREYWKGDEGKVPDLATRLTGSGDKFNHRGRRPWASVNFIAAHDGFTLNDLVSYNDKHNEANGEDNKDGHSDNKSWNMGVEGPTDDPDIRQQRERQKRNLLATLLLSQGTPMILAGDEFGRTQKGNNNAYCQDNEISWVDWEAIDDDGRALIEFVRNLTTLRHRLPVLRRGRFLTGEYNEALDVTDARWISPDGKDLSQEQWDDASMRCFGLVIDGRAQASGIRRPASDATLLLVLNAHHDVVNFTLPDIPEGQRWTCLLDTNMPVRSELPHFAAGDAYQVTARSLLLLALEAPSRATQRVFDRLEEQLTTEDSEPPAQA

SEQ ID NO: 9842 - protein, 766 aa, Debaryomyces hansenii
MNTNLLYIPYRETDIIDLGNELRNIIKMEYFQPSSNFDRDLQAVRNLRNNISNLKNEQVNNNDETVCVQYYHQLSNVIKKFPDECVEFSWYGTLGYGRSGPTRSRSLRIEQLNILYQLGSYFSQAALMESRYSDEGLKKSCSYLQAAAGCFNSMILQIQKENEKETGMIRIPRDLQPETLQFLKSLMIAQAQETIWQKSLASGMKDSVIARLSIQTSEYYSTAAKYGNSSEFIKLEWINHVTVKQFHFKAAAHYRVSILNHEGFKYGEQVASLQVALSSCDSAFRKKKYVNDFVIEDLQGLTETIKSTLRVAEKDNDLVYLKPVPKENDLAPIPGASLVKPILPPAIESFDDSSVLFKELLPYLIVQVGQAYRERQDSFIRDLFIDPIQSLNKIMYKFITERNLPASIDTIQKPENLPESIIQHSQEIISYGGTKLIEDSLNEIAKLTLESRHILEGCQERLKIEADEDDIMRERQGSQRWARPKSSEASSEFINKINKMEQYLDQAKEGDQFIISQYHEIEPYLQLYCGGYKELIQFIPNSTYVKLDTKINEIIIKLRELINEVSRIENQRKQFLTRIEIKARNNNILPSIIDSFKKKQRKLYEENAAIDERSFEDVYAKHITMFNSDLRFLEDLKHAQIALEGNIDDLNQEFESEYQHTNNESQYKRQEVLQTLENVYTKYLELISNLNEGSKFYSDFIIKSNSVLKECDEYVYHRRVEGRELEMFLNNQAVPVESVGSQQLAPDFPPQPMGGTWNPNNGIKFG

SEQ ID NO: 9843 - protein, 911 aa, Arabidopsis thaliana
MEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRQLDSNCKRWVICTGTLTNNVDVFFEEMNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGMVGLKHGILIEKLPMHILCAPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 9844 - protein, 446 aa, Unknown
  Piromyces sp. E2
AKSIELEDKFENLGARIVQDVAIKTNDEAGDGTTTATVLARAIFAEGLKNVSAGVNPVELRRGVQKAVDVVVDFLKEKAHPISTFEEIAQVGTISANGDKHIGDLLAEAMKKVGKEGVINIHEGKTLEDELTITEGMKFENGYLSPHFITDNKGKKCELENPYILIIADDIQGDALATCVLNKIRGQVQVCCIKAPGYGDHRKNNLGDIACLTNATVMSANVELTLDKLKEEHLGTCERITVTREDTVFLNGAGDKAKIAERCNQIRSVIKEADLSVYEKERHEERLAKLTGGVAVIKVGGVSEVEVGEKKDRFVDALHATRAAIEEGIVPGGGTALLKASKVLTNLKADTFDQQLGVDLVKKAIQEPCKTIVNNAGGEGAVVVGRLYNSFEVKGVEDKAVSKKDYKPFAYGFDAYKGEYCDMIKAGIIDPVKVVRTAILDASGVA

SEQ ID NO: 9845 - protein, 343 aa, Saccharum sp.
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 9846 - protein, 460 aa, Ralstonia metallidurans
MSDMQEHKVTPYDQFNYEVPENVFPREGISANAAAAIVISDEWTDTNPMLNMSSFVTTFAEPEAREVAARNIFKNYIDHDMYPRLFAMEGRMVRWLHELWNGPKGVEPYGTCTVGSSEACMLGGLAHKWNWRQRRQAEGKDATRPNMVTGGNVQIVWKKFLRYFDVEPRIVPLKPGNYCLTAEDLDKYVDENTICVVAIAGQTFTGEDDDIQGIHDWLDAYEKRTGISIPMHIDGASGGFVNPFLYPDYKWDFRLPRVQSINASGHKYGLTPPGLGWVVFRERKIFNEELVFYVNYLGGEMPTATLNFSRNAFQVAVQYYQFLRLGFDGYKRVMQHTLDNAIFLRQQLVDSGYFDIMNTTQRIPVVAVTLNKKYKNFNEFDVSNKVREKGWVLSAYTMPPNAESVTSLRVVVRPHVNHNVAQLLANDIINACKFLEANGGNAKPPALHKHAEAQSTSLKC

SEQ ID NO: 9847 - protein, 193 aa, Magnetospirillum magnetotacticum
MKNSVLFDSVGLGPYTLRNRIVLPPLTRSRSSQPGNIPNDLMAAYYRQRTGAGFMVTEGTQIEPRGQGYAWTPGIHSPEQIAGWRKVTDTVHAEGGIIFLQLWHVGRVSHTSLQPGGAAPVAPSAIAANAVKVFIETGPGEGALAEPSIPRALTTAEVQGAGAALCAGGTQCARSRFRWRRDPLRERYLVNQF

SEQ ID NO: 9848 - protein, 738 aa, Chlamydia trachomatis
MDPFFLNTQHVELLVSGKQSSPQDLLGIVSESLNQDRIVLFRPGAETVFVELRGKIQQAESHHSGIFSLPVMKGISPQDYRVYHQNGLLAHDPYAFPLLWGEIDSFLFHEGTHQRIYERMGAIPCEIDGVPGVRFIVWAPHAQRVSVIGDFNGWHGLVNPLHKVSDQGVWELFVPGLTAGACYKWEMVTESGQVLIKSDPYGKFFGPPPWSVSVVIDDSYEWTDSEWLEERIKKTEGPMNIYEVHVGSWRWQEGQPLNYKELADQLALYCKQMHYTHVELLPVTEHPLNESWGYQTTGYYAPTSRYGSFEDLQYFIDTMHQHGIGVILDWVPGHFPIDSFAMSGFDGTPLYEYTRNPSPLHPHWHTYTFDYAKPEVCNFLLGSVLFWIDKMHVDGIRVDAVSSMLYLDYGRYAGEWVPNRYGGRENLDAIRFLQQFNTVIHEKYPGVLTFAEESTTFPKITVSVEEGGLGFDYKWNMGWMHDTLHYFEKDFPYRPYHQSDLTFPQWYAFSERFLLPFSHDEVVHGKRSLIGKMPGDAWRQFAQLRLLLGYQICQPGKKLLFMGGEFGQGREWSPGRELDWELLDISYHQGVHLCSQELNALYVQSPQLWQADHLPSSFRWVDFSDVRNGVVAYLRFADADAKKALLCVHHFGVGYFPHYLLPILPLESCDLLMNTDDTRFGGSGKGFREPEILTPEIARQEREAAGLIEADDESGPDCWGLDIELPPSATLIFSVTLQ

SEQ ID NO: 9849 - protein, 90 aa, Kluyveromyces lactis
PAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 9850 - protein, 678 aa, Gibberella zeae
MAGNKLLVYLLRRDLRATDNPILHHLATSDHGFTHLLPIYILPPHQIETSGFVVEGQKSPYPLAKSQVGRFWRCGPLRAKFQAECIWDVKKNFENIGSGMLIRIGKFDDVLKHLIKSLNEDHQSIDTVWMTEEPSKEELDDQTAVASVCSKEGIGFKLWHDEKYFIDEKTQEPLRERPRPPLPRPQAGSLPSFPSWIPPQQAPFRIPDDYDEFERLLLEPVKAPIISDPPQFPEGAKSAHPFKGGETPAWDRLYHLIKSGAMTTYQETRNGLLGTEYSTKLSAFLAMGTITARSIHAELVKFEDGSEESYSRGFGFGKGENEGTRAVRFELLWRDYMRLCTFKFRTRLFKIDGFKGASGNYTKKWLTDREEDAEPDQNPTPAQVKDMIDRWIRGTTGMGLVDASQRELQLTGYTSNRARQNVASYLTKSLGIDWRLGAEYYEQSLIDYDTHSNWGNWQYQASCGNDPRSRSFNQVKQAFDYDQDGRFTRTWVNEVKSIDRLEHVFQICTCPKQELEKHGLSDNIMVTNPLKRIDFSVTKPRGNRRPYRWRKQGDRGRGGRGGRGGGTGNTSGNGDNRHNEPSPPNGGNRHNDFSPANGGSYMQGQPISGGYQQMAWRGNSHGLPSGRGYNSRQYMLDYSQQQQQPQHQLQHYYAHQQHQHPHPRQQQQQFYHQIPPHI

SEQ ID NO: 9851 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 9852 - protein, 482 aa, Lactobacillus gasseri
MTGYTMPKGFLWGGAVAAHQLEGAWNEDGKGMSVADVMTVGSATKPREITDGVIPGKNYPNHDAIDFYHHYKGDIKLMAEMGFKAFRTSIAWTRIFPKGDEKEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYELVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLQRSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGEGTLERSKKDSFDWYKKVIESNGKDLD

SEQ ID NO: 9853 - protein, 144 aa, Saccharomyces cerevisiae [sequence omitted]

SEQ ID NO: 9854 - protein, 238 aa, Glycine max
  misc_feature (80)..(80): Xaa can be any naturally occurring amino acid
SARALTSSSSTFIPKRYSFFFFLSILFALRSSSGGCSEYHHHHAPMATIGGLRDSQGSQNSVQTEALARFAVDEHNKKQXVRTQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 9855 - protein, 1128 aa, Oryza sativa
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVRSLFTDPGTTALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 9856 - protein, 907 aa, Pseudomonas syringae
MLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 9857 - protein, 187 aa, Arabidopsis thaliana
MRTFSPKLLLLLLLVLRHHAESGSIVKFLPGFEGPLPFELETGYIGIGTLAKYWANDERVREALQIRKGSIGKWIRCNSNIHYDDDIISSIPYHMNNSINGYRSLIYSGDHDMEVPFLATEAWIRSLNYPIIDDWRPWIINNQIAGYTMTYANKMTYATIKASGHTAEYKPAESFIMFQRWISGQPL

SEQ ID NO: 9858 - protein, 451 aa, Arabidopsis thaliana
MLIPNKKLREMNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 9859 - protein, 404 aa, Haemophilus somnus
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKHQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLARFLEYYRQ

SEQ ID NO: 9860 - protein, 439 aa, Arabidopsis thaliana
  misc_feature (117)..(117): Xaa can be any naturally occurring amino acid
  misc_feature (208)..(208): Xaa can be any naturally occurring amino acid
  misc_feature (214)..(214): Xaa can be any naturally occurring amino acid
  misc_feature (380)..(380): Xaa can be any naturally occurring amino acid
MAAAVSTVGAINRAPLSLNGSGSGAVSAPASTFLGKKVVTVSRFAQSNKKSNGSFKVLAVKEDKQTDGDRWRGLAYDTSDDQQDITRGKGMVDSVFQAPMGTGTHHAVLSSYEYVSXQGLRQYNLDNMMDGFYIAPAFMDKLVVHITKNFLTLPNIKVPLILGIWGGKGQGKSFQCELVMAKMGINPIMMSAGELESGNAGEPAKLIXRQRYRXAADLIKKGKMCCLFINDLDAGAGRMGGTTQYTVNNQMVNATLMNIADNPTNVQLPGMYNKEENARVPIICTGNDFSTLYAPLIRDGRMEKFYWAPTREDRIGVCKGIFRTDKIKDEDIVTLVDQFPGQSIDFFGALRARVYDDEVRKFVESLGVEKIGKRLVNSRXEGPPVFEQPEMTYEKLMEYGNMLVMEQENVKRVQLAETYLSQAALGDANADAIGRGTFY

SEQ ID NO: 9861 - protein, 230 aa, Zea mays
MWSSGSDRDEAVDTANASSVDASSPARQPSTPPPPPRRRRQRARRRAHRLRARNTGAGAEEEGLVEADADADDVWRGLQQQREREAWLRRASRPVVVVAGEEGSPPDASAGSGESGGVGRARSLTDDDLEELKGCVDLGFGFSYREIPELCGTLPALDLCYSMSQRFLDEHHHQQLGKAEEAPPLAPASPAQPAATTNWKISSPGDSPDEVKARLKYWAQAVACTVRLCS

SEQ ID NO: 9862 - protein, 341 aa, Desulfitobacterium hafniense
MLPLFEPIRIKDLEIKNRIVMPPMALDIATEQGAITHKLIEHYRMRTRGVGMIIVEHAYVNPEGKAHPRQLGIHRDDLIPALEHLAAEIHKQGAVVGIQISHGGARSMGNICGPSSIQSQYLTRFGEADRKNCRVLPRKLDQEGIKGIIADFARAARRAQKAGFDFVEIHGAHGYLVNQFYSPLTNIRHDEYGGSLERRLTFPLEVVKSVRRVVGKSMPIFYRLGADDRLPGGNTVQDSALAAQALEAAGVDCLDLSGGISGYLRHGEEGFFAYMGQAIKPQVTIPVMVTGGIKTGNKANEMIAGGIADFVGVGRTLLKENEWAYKEWVRMGSGTCPYQAI

SEQ ID NO: 9863 - protein, 554 aa, Erwinia carotovora
MCSIFGVLDLKSDPVELRKKALELSRLMRHRGPDWSGVYASDKAILAHERLSIVDVNTGAQPLYNAERTHILAVNGEIYNHQALRQQYGDRYAFQTGSDCEVILALYQEKGPEFLDELRGMFAFALYDSEKDAYLIGRDHLGIIPLYMGYDEHGNLYVASEMKALVPVCRTIKEFPAGSYLWSKDGEIREYYQRDWFDYDAVKDNETDKVALHDALEEAVKSHLMSDVPYGVLLSGGLDSSVISAITKKYAARRVEDDARSEAWWPQLHSFAVGLEGAPDLKAAQEVAKHLGTVHHEIHFTVQEGLDAIRDVIYHIETYDVTTIRASTPMYLMSRKIKAMGIKMVLSGEGSDEVFGGYLYFHKAPNAKELHEETVRKLLALHQYDCARANKAMSAWGVEARVPFLDKNFLDVAMRINPRDKMCGNGKMEKHILRECFESYLPHSVAWRQKEQFSDGVGYSWIDTLKEVAANQVTDQQLETARFRFPYNTPGSKEAYLYREIFEELFPVSSAAECVPGGPSVACSSAKAIEWDESFKTLDDPSGRAVGVHQSAYK

SEQ ID NO: 9864 - protein, 411 aa, Colwellia psychrerythraea
MKAITKSSKLHNVCYDIRGQVAVEAKRLEDEGHKILKLNIGNPAPFGFEAPDDILKDVIHNLPNSQGYSESQGIYSARVAVMQYFQQQGIKDVMVDDIFIGNGVSELIVMAMQALLDNGDEVLIPAPDYPLWTAAVSLSGGKPVHYRCDEQNHWFPDLEDMESKITKKTKAIVLINPNNPTGAVYSEEVLHAIIALARKHGLIIYSDEIYDKILYDEAKHVPTAALATDVFIITLGGLSKNYRIAGFRAGWMVISGPKLHAEDYIKGIKLLSSMRMCANVPSQHAIQTALGGYQSINELIRDDGRLIKQRNVAYKMINDIDGLSCNPAMGALYLFVKVDNKKFNITNDERMVLDLLKQEKILLVHGRAFNVKEHNYFRLVFLPHVDELIPALEKLKSFFASYKQVQPSKSA

SEQ ID NO: 9865 - protein, 367 aa, Arabidopsis thaliana
METKQSIPLLMPYKMGPFNLSHRVVLAPLTRSRSYGNIPQPNAKLYYTQRTTPGGLLISESCVVSETSLGYPDLPGLWNRDQVEAWKPIVDAVHSKGGIFFCQIWHGGRVFHQDQPNGEAPVSSTDKPLMCKNMYGGQFKPPRRLRSDELPAIVNDFRIAARNAIEAGFDGVEVHGAHGYLIDQFLKDKVNDRSDQYGGSLENRCRFALEVIEAVVNEIGSDRVGIRLSPFADYMESGDSNPEALGLYLVQAMNKHVVYGHMVEPRMKTLEGIFECTESLTPMRKAFKGTFIVAGGYSREDGNKAVEEGRTDLVAYGRPFLANPDLTRRFELNEPLNRYDRSTFYTSDPVVGYTDYPFLETTDTTTA

SEQ ID NO: 9866 - protein, 341 aa, Pyrococcus horikoshii
MITIDGSYGEGGGQILRTSVALSTITGEPVRIVNIRANRPNPGLRPQHLHAILALKHLANAEVKGAHVGSRELVFIPKKLEAKEISIDIGTAGSITLVLQALLPAMVFAREKVKFRITGGTDVSWSPPVDYLSNVTLFALEKIGIHGEIRVIRRGHYPKGGGIVEGYVEPWNEKRELVAKEYSRIIKIEGISHATNLPSHVAERQARAAKDELLQLKVPIEIRTEISRSIGPGSGIVVWAETDCLRLGGDALGKKGKPAEIVGKEAAQELLDQLKPGHCVDKFLGDQLIPFLAFSGGVIWVSEITNHLKTNIWVVESFLGRIFDVDGNVGEPGKIRVIRRV

SEQ ID NO: 9867 - protein, 400 aa, Magnaporthe grisea
MATTQTTQGQIQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAVDLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDLEEMQAILNADYSFTPIEFWRGVSDSAKDFIRRCLTIDPTKRMSAHEALQHPFVAGYLADKGANLLPTVKKNFNARRTLHAAIDTVRAINKLREGQGLNGQRLMAGVKSREPNKAAAAAAAAASIPTSTGEVGTVGAATHKDSGYGSTRPDALRPGVETNKVVETSKGLWTGVGSRG

SEQ ID NO: 9868 - protein, 113 aa, Triticum aestivum
GMTCNKAEGAMYLFPRLHLPQKAIGAAQAAGAAPDAYYALRLLQATGIVVVPGSGFGQAPGTYHFRCTILPQEDKIPAIISRFKEFHEKFMDEFRDVSRDEAPTGTTIESGGD

SEQ ID NO: 9869 - protein, 277 aa, Triticum aestivum
ISFLILNLKAGSPNTNKSQTPPTQKFPKIIRTQTEIPTPIRLPPPVSPPSSIPNEARVSARRTAMGSSKGSPPPSAAGPSSAGNAPAPVGPVPRPPEVAPFLTKVYDMVSDAATDKVMSWTDAGNSFVIWDAHAFERDLLSRHFKHRNFSSFIRQLNTYGFRKVDPDRWEWANEGFLRDQKHLLKIIKRKKRPQEAGRELEKAPVKAAPGTENIEIGRYGGLVKEVETLKRGGGVLMQQLVDLTHYQQSSNLEVQSLIQRLQVMEQNQKQMMALLSI

SEQ ID NO: 9870 - protein, 153 aa, Daucus carota
  misc_feature (65)..(65): Xaa can be any naturally occurring amino acid
DPKHLRRPQQRLRPLLPRHLRPLPRLPQRSLHRYRGRTERSHGTCNMRIDWKETPDDVFKADMPXLKKEEVKVEVEEGRVLQISGERSREQEEKNDKYHRVERSSGKFLRRFRLPENVKMEEVKACMENGVLTVTVRKWRRRSRNVKAIDISG

SEQ ID NO: 9871 - protein, 645 aa, Bacillus cereus
MNVINCEEVKRDEFHTEKYYESYNIFGAHVVTEDEIQGVRFTVWAPHAKAMSVVGDFNEWDYEQHKMLQVTEEGIWSLFIPHIEEGEIYKYAIETLAGDVILKADPYAVYAEVRPNTASVVFDIKGYEWNDKNWNRKKKKKSIYKEAMTVYELHFGSWKKKEDGTLYSYREMVEELIPYVVEHQFTHIEIMPLVEHPYDRSWGYQGTGYYAATSRFGTPHDLMHFVDECHKYGIGVILDWVPGHFCKDAHGLYLFDGTPTYEYKDKDVQENPVWGTVNFDLGKREVRNFLISNALFWMRYFHIDGFRVDAVANMLYWNKEGQEQSNEHAVSFLRELNEAVFAEDEDFLMTAEDSTAWPLVTTPTYEGGLGFNYKWNMGWMNDVLKYMECAPEYRKHIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSPEGFQWIDANNNEQSIFSFIRQGDKQEDALVIVCNFTKATYENYKVGVPDFEYYNEILNSDAQQYGGSGQVNKKRLKTILEPYHNQAAHVEITIPPFGVSILRPVKTRKGSKKQDGSKTKVRSNVTSRGKR

SEQ ID NO: 9872 - protein, 706 aa, Pseudomonas tolaasii
MAQLKDGNLETCLAPLGSQELDQLASGINRMAETLQNAQEELQHSIDQATEDVRQNLETIEIQNIELDLARKEALEASRIKSEFLANMSHEIRTPLNGILGFTHLLQKSELSPRHVDYLGTIEKSADNLLGIINEILDFSKIEAGKLVLDSVPFNLRDLLQDTLTILAPAAHAKQLELVSLVYRDTPLAVVGDPLRLKQILTNLISNAIKFTREGTIVARAMVEDEEEDSVQLRISVQDTGIGLSNQDVRALFQAFSQADNSLSRQPGGTGLGLVISKRLIEQMGGEIGVDSTPGEGSEFWISLNLPKTRDDVDDLPSAPLLGRRVAVLENHDVARQALQHQLEDCGLEVTPFNTLESLTNGITSTHQTEQAIDLAVLGVTANDIPPERLNQHLWDLEHLGCKVLVLCPTTEQMLFNQSVPNPNSQLQAKTPCTRKLRRALADLISPPVAQRTREPLSSRAPRVLCVDDNPANLLLVQTLLEDMGAKVLAVESGYAAIDAVKQETFDLVLMDVQMPGMDRRQSTEAIRQWESERHGTPLPVVALTAHAMANEKRALLQSGMDDYLTKPISERQLAQVVLKWTGLALRNQGPERGNDNLGHGVQLLVLDHEEGLRAAANKADLAADMLAMLLASLEADRLAITVAREAKDNNALIERIHRLHGATRYCGVAELRAACQRAETLLKQDDAQGHGALDELDMAIGAAGQ

SEQ ID NO: 9873 - protein, 639 aa, Lactuca sativa
MMMDSCDCFETQWPADELLVKYQYISDFFIAFAYFSIPLELIYFVQKSAFFPYRWVLMQFGAFIVLCGATHFINLWTFSSHSKTVAIVMTIAKLSTAFVSCVTALMLVHIIPDLLSVKTRELFLKQRAEDLDREMGLIIKQEETGRHVRMLTHEIRSTLDRHTILKTTLIELGRTLDLEECVLWMPSRKGMILQLSHSLHNLIPFASTVPINLPIITEVFNSAEAIRIPHNCPLARIRTPVGSYIPPEVVAVRVPLLHLSNFEIDNWPDHSAKSYAVMVLILPLNGVRKWRDHELELVTVVADQVAVALSHASILEESMRARDQLMDQNFALNVARQEAEMAIHARNDFLAVMNHEMRTPMHAIIALSSLLLETELTPDQRAMIETILKSSNLLATLVNDVLDLSRLEDGSLELESEVFNLHGLLREVVRLINPIASVKNTSMTLNCDVDLPNFGVGDEKRLMQIILNVVGNAVKFTKGGHVSIQASVLNPEYLQEWQTPEFCPTFTQGLFYLLVQVKDSGSGIKQQDIPHIFTKFSEPRSASNRSGDGAGLGLAICKRFVDMMGGHIWIESGGLGKGTTVAFLVKVGECNYQNDLSIVRPKARTRPHQGSGELIKHRGDESYRGGGTASFPAHDHNSF

SEQ ID NO: 9874 - protein, 445 aa, Lactuca sativa
MAIEIVQPSVGLSKIAVSETHGEDSPYFAGWKAYDENPYDEVHNPTGVIQMGLAENQVSFDLLEEYLEANLEASNWGQKVSGFRENALFQDYHGLQSFRKAMASFMEQVRGGKAKFNPDRVVLTAGATAANELLTFILADPGDALLVPTPYYPGFDRDLRWRTGVQIVPIHCESSNNFQITPEALEAAYDHARAMNIKVRGVLITNPSNPLGATIQRKVLEEILDFVTRKNIHLVSDEIYSGSAFYADEFVSIAEVLESRDYKDAERCHIVYSLSKDLGLPGFRVGTVYSYNDQVVTTARRMSSFTLISSQTQFLLASMLSDKEFTQKYIKINRERLKKRYEMIINGLRKAGIECLEGNAGLFCWMNLSPYLEDATINSEIAIWKTIMHEVRLNISPGSSCHCSEPGWFRVCFANMSEETLDVALSRIHEFIERRKQDRQMVCIQ

SEQ ID NO: 9875 - protein, 737 aa, Lactuca sativa
MDSCNCIEPQWPADELLMKYQYISDFFIALAYFSIPLELIYFVKKSAVFPYRWVLVQFGAFIVLCGATHLINLWTFNAHTRTVAIVMTTAKVLTAAVSCATALMLVHIIPDLLSVKTRELFLKNKAAQLDREMGIIRTQEETGRHVRMLTHEIRSTLNRHTILKTTLVELGRTLGLEECALWMPTRSGLELQLSYTLRHQNPVGFTVPIQSPAINQVFSTNRAVKISPTSPVARLRPASGKYMLGEVVAVRVPLLHLNNFQIYDWPELSTKRYALMVLMLPSDSARQWHVHELELVEVVADQVAVALSHAAILEESMRARDLLMEQNVALDLARREAETAVRARNDFLAVMNHEMRTPMHAIIALSSLLQETDLTPEQRLMVETILKSSNLLATLINDVLDLSRLEDGSLELDTTTFNLHALFKEVLNLIRPVASVKRLFVTLSLSSDLPEYAVGDEKRLMQIILNIIGNAVKFSKEGSISISAIMAKPDSLRDPRAPDFFPLLSDNNFFLRVQVKDTGMGISQQDMPKLFTKFAESQSPATRNPGGSGLGLAICKRFVNLMEGNIWIESEGLGKGSTAIFFVKLGFPSRLNGSRLPHMRVPAKLGQTKFPGLKVVVVDDNGVSRTATKGLLVHLGCDVTTVSSGEECLQAITKDSYKVVFIDVSLSSDAYNVARLVHEKLPKRHEKPPPLIVGLTGNTDKAMKESLLRAGMDGLVLKPVSVEKMRLALSELLEHNT

SEQ ID NO: 9876 - protein, 738 aa, Nicotiana tabacum
MDCNCFDPQWPADELLMKYQYISDFFIAVAYFSIPIELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRTLALEECALWMPTPPGLELQLSYTLRHQNPIGFTVPIQLPVINQVFGTNRAVKISPNSPVARLRPAGKYMPGEVVAVRVPLLHLSNFQINDWPELSTKRYALMVLMLPSGSARQWHVHELELVEVVADQVAVALSHAAILEESMRARDLLMEQNVALDLARREAEMAVRARNDFLAVMNHEMRTPMHAIIALSSLLQETELTPEQRLMVETILKSSNLLATLINDVLDLSRLEDGSLQLDVGTFNLHVLFRKVLNLIKPIASVKNCLSRLTCLQICPEFAIGDEKRLMQILLNVVGNAVKFSKEGSVSISAVAAKSESLSDPRAPEFFPVQSENHFYLRVQVKDTGSGINPQDIPKLFCKFAQNQALATKSSGGTGLGLAISKRFVNLMEGHIWIESEGLGKGSTAIFIVKLGIPGRSNEPKLPFMPRLPANHMQMTFQGLKVLIMDDNGFSRMVTKGLLVHLGCDVTTVSSGDECLRVLTQEHKVVFMDVSIPGIDCYEVAVQIHEKFGKHHNRPLIVALTGNTDRVTKENCMRVGMDGVILKPVSVDKMRSVLSELLEHGVILQS

SEQ ID NO: 9877 - protein, 482 aa, Streptomyces avermitilis
MASAETSAAPVSPVTFPPAFLWGAATSAYQIEGAVREDGRTPSIWDTFSHTPGKTAGGETGDIAVDHYHRYRDDVALMAELGLGAYRFSVSWSRVQPMGRGPAVQRGLDFYRRLVDELLAHGVKPALTLYHWDLPQELEDAGGWPERDTAYRFAEYAQIVGDALGDRVEQWITLNEPWCSAFLGYGSGVHAPGRTDAAASLRAAHHLNLAHGLGTSALRAAMPARNTVAVSLNSSVVRTVSDSPADVAAGRRIDDLANGVFHGPMLHGAYPAGLFAATASVTDWSFVQDGDLEAVNQPLDALGLNYYTPTLVSATESAPAGPRADGHGASSFSPWPGADDVVFHLTPGERTEMGWSIDPTGLHELIMRYTREAPGLPLYITENGAAYDDKPDPEGRVHDPERIAYLHGHLTAVRRAITDGADVRGYYLWSLMDNFEWAYGYGKRFGAVYVDYATLARTPKSSARWYAQAARTGTLPGATAAE

SEQ ID NO: 9878 - protein, 552 aa, Ehrlichia canis
MANVVVTGEQLDKAIREVVHILEDAVGCTAGPKGLTVAISKPYGAPEITKDGYKVIKSIKPEDPLALAIANIIAQSASQCNDKVGDGTTTCSILTAKVIEEVSKAKAAGADIVCIKDGVLKAKEAVLDALMSMKREVLSEEEIAQVATISANGDKNIGVKIAQCVQEVGKDGVITVEESKGFKELDVEKTDGMQFDRGYLSPYFVTNSEKMLVEFENPYILLTEKKLNIIQPILPILENVARSGRPLLIIAEDVEGEALSTLVLNKLRGGLHVAAVKAPGFGDRRKDMLGDIAILTGAKHVISDDLAIKMEDLTLAELGTAKNIRITKDTTTIIGSVDNSSDNVQSRINQIKVQIESSTSDYDKEKLRERLAKLSGGVAVLKVGGSSEVEVKERKDRVEDALHATRAAVEEGVVPGGGAALLYTLSVLENLKSKNDDEQLGINIIKRALQAPIKRIIRNSGSENAPCVIAHLLKQNDKELIFNVDTMNFANAFTSGVIDPLKVVRIAFDFAVSLAAVFMTLNAIVVDVPSKDDAGAAGGAGGMGGMGGMGGF

SEQ ID NO: 9879 - protein, 189 aa, Oryza sativa
MGRGKIEIKRIDNATSRQVTFSKRRSGLFKKARELSILCDAEVGLLVFSSTSRLYDFASSSMKSIIERYNETKEDPHQTMNASSEAKLWQQEAASLRQQLHNLQEYHRQLLGQQLSGLDVEDLQNLESKLEMSLKNIRLRKDNVMMDQIQELSRKGSLIHQENMELHKKVSLVHQENINLQKKVAVPTA

SEQ ID NO: 9880 - protein, 485 aa, Arabidopsis thaliana
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSRQNP

SEQ ID NO: 9881 - protein, 741 aa, Unknown
  Malus x domestica
MLACNCIEPQWPADELLMKYQYISDFFIALAYFSIPLELIYFVKKSAVFPYRWVLVQFGAFIVLCGATHLINLWTFSIHSRTVAMVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISANSPVAKLRQLAGRHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTAEQRLMVETILRSSNLLATLINDVLDLSRLEDGSLQLEIATFNLHSVFREVHNMIKPVASIKRLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQALATRNSGGSGLGLAICKRFVNLMEGHIWIESEGLGKGCTATFIVKLGFPERSNESKLPFAPKLQANHVQTNFPGLKVLVMDDNGVSRSVTKGLLAHLGCDVTAVSLIDELLHVISQEHKVVFMDVSMPGIDGYELAVRIHEKFTKRHERPVLVALTGSIDKITKENCMRVGVDGVILKPVSVDKMRSVLSELLEHRVLFEAM

SEQ ID NO: 9882 - protein, 372 aa, Triticum aestivum
GPECSGYRRPTRPNIFLTDGASPAVHMMMQLLIRSEKDGILCPLPQYPLYSASIALHGGAFVPYFLDEEAGWGLEVDELKKQVDEARSKGITVRALVVINPGNPTGQVLAEENQKKIVEFCKNEGLVLLADEVYQENIYVEDKQFHSFKKIARSMGYTDDDLPLVSFQSVSKGYYGECGKRGGYMEVTGFNADVREQIYKVASVNLCSNISGQILSSLIMNPPKVGDESYESFMVERDGIISSLARRAKALEEAFNSLEGITCNKAEGAMYLFPRLHLPQKAIGAAQAAGAAPDAYYALRLLQATGIVVVPGSGFGQAPGTYHFRCTILPQEDKIPAIISRFKEFHEKFMDEFRDVSRDEAPTGTTIESGGD

SEQ ID NO: 9883 - protein, 157 aa, Arabidopsis thaliana
MSLIPSIFGGRRTNVFDPFSLDVFDPFEGFLTPSGLANAPAMDVAAFTNAKVDWRETPEAHVFKADLPGLRKEEVKVEVEDGNILQISGERSNENEEKNDKWHRVERSSGKFTRRFRLPENAKMEEIKASMENGVLSVTVPKVPEKKPEVKSIDISG

SEQ ID NO: 9884 - protein, 391 aa, Lactococcus lactis
MPNQLTDHVTLRHGATLNNRIVMSPMQTHSGLKGGFASDDTIQYYSARSRAAGMLITEFHYVSENGGPAYVPGYPEQLGAYSDAHLEGLRKTVQALKKDGNKAILQIHHAGRAAVGRHVNGLDVVAPSAIDFSFLDYPVRELTITEIDDIILDFGKATKRAIDAGFDGVEIHGANHYLIQQFFSKLSNLRTDKWGGSLNKRMAFPLAVVKEVKAIVDEYAPKGFIIGYRISPEELHGKNVGYDYTEALTLISEVIKYELDYIHLSLWAGYNSKPENSEKSYAELFKEILDDKTKLLIVGGIFGEDTATDAIENYADLIAVARGTLIDPNFAKKVTEGKGDTILHKISPETVEYSHLTPGLLEAFSREDSLGLPPLPGGETIRHLHTGKYDI

SEQ ID NO: 9885 - protein, 464 aa, Listeria monocytogenes
MTYKFPENFWWGSAASGPQTEGAADVDGRKPSIWDHWYKIEPGRFFNDVGPTNTSNFYYQYKEDIALMKQTGHNSFRTSIQWSRLIPDGIGEVNPKAVDFYNRVIDEMLANDVEPFMNLYHFDMPMSMQEKGGFESREVVDAYATFAKTCFELFGDRVKHWFTFNEPIVPVEAGYLYDMHYPNVVDFKRATQVAYHTTLAHALAVKEFHALEIPEGQIGIILNLTPSYPRSQNPADLKAAHIADLIFNRSFLDPVTKGEFPTDLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGANCHGYHLWTFMDCWSWANAYKNRYGLVEVDLDNDFKRTVKASGHWYKELAENNGFED

SEQ ID NO: 9886 - protein, 365 aa, Arabidopsis thaliana
MLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAENVKEKKMEKEILMEVIVGWRKFVKERKKMNGVC

SEQ ID NO: 9887 - protein, 104 aa, Arabidopsis thaliana
  misc_feature (44)..(44): Xaa can be any naturally occurring amino acid
  misc_feature (55)..(55): Xaa can be any naturally occurring amino acid
  misc_feature (89)..(89): Xaa can be any naturally occurring amino acid
INVSGHKYGLVYAGIGWVVWRAAEDLPEELIFHINYLGADQPTXTLNFSKGSSQXIAQYYQLIRLGFEGYKNVMENCIENMVVLKEGVXETRGVQHRKGPRGFP

SEQ ID NO: 9888 - protein, 547 aa, Pseudomonas aeruginosa
MAAKEVKFGDSARKKMLVGVNVLADAVKATLGPKGRNVVLDKSFGAPTITKDGVSVAKEIELKDKFENMGAQLVKDVASRPTDAAGDGTTTATVLAQAIVNEGLKAVAAGMNPMDLKRGIDKPTVAIVAQLKELAKPWRDTKAIAQVGTISANSDESIGQIIAEAMEKVGKEGVITVEEGSGLENELSVVEGMQFDRGYLSPYFVNKPDTMAAELDSPLLLLVDKKISNIREMLPVLEAVAKAGRPLLIVAEDVEGEALATLVVNNMRGIVKVAAVKAPGFGDRRKAMLQDIAILTGGTVISEEVGLSLEGATLEHLGKPKRVVINKENTTIIDGAGVQADIEARVLQIRKQIEETTSDYDREKLQERLAKLAGGVAVIKVGAATEVEMKEKKAPVEDALHATRAAVEEGVVPGGGVALVRALQAIEGLKGDNEEQNVGIALLRRAVESPVRQIVANAGDEPSVVVDKVKQGSGNYGFNAATGVYGDMIEMGILDPAKVTRSALQAAASIGGLMITTEAMVAEIVEDKPAMGGMPDMGGMGGMGGMM

SEQ ID NO: 9889 - protein, 127 aa, Brassica napus
  misc_feature (69)..(69): Xaa can be any naturally occurring amino acid
  misc_feature (78)..(78): Xaa can be any naturally occurring amino acid
DEHCKRYMFMTEEDITSLPCFQNQTLLAIKAPTASCIEVPDPDEVMSFPQRQYRMVIRSRMGPIDVYLXRTKHGCSKXKGDSSMETDESAVDTSSLKIVTSDTDLKTDYWFESGEEVTLTDLWNNFC

SEQ ID NO: 9890 - protein, 488 aa, Pseudomonas fluorescens
MIQTETDMQLIWLRSDLRQHDNTALAAAAERGPSVAVYLLSPQQWQEHDDAPCKIDFWLRNLHKLSKSLGDLNIPLLIRTAPHWDQAPAVLLELCRQLKIEAVHVNEEYGINESRRDAAVAKALQAEGITFHSYLDQLLFKPGSVLTRTGTYFQVFSQFRKVCYEHLHRSMPSLKQAPGKQSALNIASDPVPEAIEGFPTPGASLRALWPAGETEARRRLDTFADAQIDYYKSERDFPAKPGTSQLSAYLAAGVISPRQCLHAALQSNQGEFESGKVGAVTWINELLWREFYKHILVGYPRVSRHRAFRPETEDLAWRNAPEDLAAWQEARTGLPIIDAAMRQLLETGWMHNRLRMVVAMFLTKNLLIDWREGERFFMRHLIDGDLAANNGGWQWSASTGTDSAPYFRIFNPVSQSEKFDSEGLFIKHWLPELAGLNKKEIHNPASVGGLFGVADYPAPIVNLSASRERALAAFKNLPSRSSQGESDE

SEQ ID NO: 9891 - protein, 536 aa, Methanosarcina acetivorans
MASKQIMFDENARKTLLTGVDKVANTVKITLGPKGRYVVLDKSTKPVVTNDGVTIAKEIELHDKFENMGAKLVKEVASRTQDNTGDGTTTATLLAQSMIREGLKNISAGANPIEVKKGIEFATEKVVEYLKNKSVEVKGKDKIIQVATVSANNDEEIGNLITDAMERVGYNGVITVEDSKTMETSLDVVEGMQFDRGFVSPYMALDTEKMNCEFEDPYILITDKKINSMKQIVPVLEKVASEGRSLLIIAEDVDGDAQAALILNIIRGSLRVCAVKAPGFGNERKEMLEDIAVLTGGQVISEEKGMKLEEFSDYMLGSARKVTVDNNKTIIVEGRGDKEKIEERVRIIEAQVNIAEADYRKTELKKRQAKLGGGVAVIKVGAATETELKEKKMRIDDALNATKAAVEEGVVTGGGVSLFRAAATLDSLSLGGDRQVGVKIVQRSIEDPVRQIAANAGREGAEVVATIRAESSERFGYNAKRDVFEDLFEAGVIDPTKVVRSGLQNAASIAGMVLTTEALVTDFDEEKDDRTAAIII

SEQ ID NO: 9892 - protein, 393 aa, Desulfitobacterium hafniense
MQESRWKEYLKNLGWVLAIGSLIFTVVVGGFIVTNLDHLGRLARVVKLVESDYLEEVSVDTLIEGATKGIVDSLGDPYSSYMNAQENEELMQQIEGKFGGVGIILSLKDPQKLVVLRPIKNTPAAKAGLQPGDVIIKIDDVDATTIDQEKAVSLMRGNPGTNVTLVVYRESIKQNVTVPLTRENIAVPTVEGLALPGNSDIAYIGISQFSSHTALELNEVLRNMDISKYKGMILDLRYNHGGELESAVGVASYFVQPGPIVYIVDKGGNAVTKASEGNYLGIPFVVLVNEESASAAEIVSGAIKDRGTGTLVGTKTFGKGIVQTIYQLDRGTSVKLTTAKYLTPNKIDIHKKGIEPDVEVKLKDGEEATLSPTTKAFDTQLTEALKVLRQQMK

SEQ ID NO: 9893 - protein, 972 aa, Vibrio fischeri
MIPALLLFPKCFNIMLFASTGIGRKLLITFMVMIALMAFGSVVGVLGFSYVEKTERTVIDSAIPAVIEARYISDLSTKIISTSQLLSQVDSEDDRKKYGKDLFESIESLYHRLKGLGVYPFDKALLARLDLQVQDIVDNLATMGESVGEKVVLHRTIQEKSQKLTETALRLEELSRSQVLNSNTVTIANVVKIYDLVENGEKEAVYKALDTLVETDLDLAERLHELRLLTFKVVNTIDDARNSHNIKKIEKLRQDFTRDMTIITRRVQAVEDPSRTKQMLDLANDLTKSERLFNELIQLVNINQKLKLLGDENVHKFQELNLTISQLLEQANDVTQQAVADVNFVLKVVQQLLISITMLGLCLVIYIMWRYVYARVITRLNQYEEAITNVANGQLDIELDTTGDDELARMGRSILIARDTAQELKEYKDSLELQIAQRTQELKSSNERLNVEIINHDKARDLAEQANRAKSAFLATMSHEIRTPLNGVLGTGELLRGSGLTAQQKQYVDIINRSGENLLDLLNDILDYSKIEAGHLSIRKKNFSVQSMITDVHHLFSSRAQQKGITLSVNVPVDTPEWWSGDCSRIRQVLNNFVGNAIKFTHTGSVTIQLSLILDTTLLFEVIDTGVGIAEHEIDTLFDVFTQAEEGMKVSGGTGLGLAISQRLIEAMDGEIGVESIEGQGSTFWFSLELDEGQPVESLSDDKTAIDIAPVNILLVEDNPVNQMVAIGFLERLGHHVIAVDTGKKAEEAIEKHQFDLLLLDINLPDTDGVTLQKRLREIYATKDDHQDELPMLAVSAHVFHEDVESYLSAGFNGFLAKPLVENQLVSTLNRILNDGKSNLKAPVIIPSLQLEMEAGIETEENEMILNEKVLQGDINVLGEDRMRKIVGVFKTSSKENLEELQTAISNQDCYQVNQLAHKLKGSAGSMGLMQLHTLCHQYEQYGKNNDISLCRNDEISQVYGAAILALDAFFK

SEQ ID NO: 9894 - protein, 1390 aa, Cryptococcus neoformans
MSLPDAYPPVIATEGSTAFQSHILSLLSVISQHPSPDYPFPSSGDSTLQDNASVTAKKNATLSTFPGKKTPAEDAIERAIIALGDRVWTSERTQAHLVKDVKRDVPAQPGSDLLTPDWTPPVPTLNDSSPDPVCPTCTRPVSSSETSSFTPQQIASFYHPFTAALSTPPPPLPEQMFFPQSVLAAYVSATSDSESAGDSGMSAEKELELLKAQVQDIARVCKAVATGDLTQKIIVPVKGQTMTELKNIINAMVDRLQTFAVEVERVSLEVGTEGKLGGQAVVPNVEGTWKVLTAVVNKLAANLTNQVRSIAKVTKAVAKGDLSETIDVEASGEIAELKTTVNGMVMSLRTLADEVSRVSLEVGSQGKLGGQANVPDVEGVWKDLTVNVNRMCESLTTQVRSIGSVTTAVARGDLSKMIEIEAEGEMAVLKNTVNSMVRQLTVFAKEVTRVALEVGTHGQLGGQAVVPGVEGVWDDLTTNVNKMARNLTDQVREIAMVTKAVARGDLSKTVNADVQGEILDLKCTVNEMLTNMPCKVAQLTVFAAEVTRVSLEVGTEGKLGGQAVVPNVEGTWMVLTDNVNLMALNLTTQVRSVAEVTTAVAAGDLSKKINVAAFGEILELKNTVNNMVDSLRSFSSEVTRVAREVGTDGRLGGQAKVPGVAGTWKDLTDCVNIMAANLTEQVRTIAHATTAVARGDLTQKVVGVKVSGEILDLVNTINNMIDQLAIFAAEVTRVAREVGTEGKLGVQAEVENIEGTWQEITSNVNTMASNLTSQVRAFAQISAAATDGDFTRFITVEASGEMDSLKTKINQMVYNLRESIEKNTKARQEAEMANRSKSEFLANMSHEIRTPMNGIIGMTVLTLESELTRQQRENLMIVSSLAGSLLTIIDDILDISKIEAGRMTMEQIPFSLRVAVFSVLKTLCVKAAQNKLDLIFDVDPTMPDQLIGDPLRLRQVITNLIGNAVKFTTKGQVALSCRVKRYVTVADAVELEFCVADTGIGIKQDKLDVIFDTFAQADGSTTRKYGGTGLGLTISKRLVNLMSGDLWVESEYGQGSRFYFTTVAEMTSVPRDQIIERLSPWSGRSVLFIDTLGDQTGIVEMLQELGLKPIVIHSVNDVYLLQDQGLTVFDTMIVDSLKAAGELRGIEYLRYIPIVLLAPSNKPSGPSNPSFISLPESRRRLLALPSASEQLLSPIPVKDCLEMGINTYYTTPLSLQELSNAIVPALESHQIQPGDTVKDTILSVLLAEDNLVNQKLAVKLMEVAGHKIEVADNGEIALEKYKRRQLARTPFDVILMDVSMPVMGGMEATGLIREFEANEGVPRTPIIALTAHAMIGDKERCLAAGMDEYVTKPLRRGDLLASIAKVLAPKQSASGLEMPAVPIPANIYGR

SEQ ID NO: 9895 - protein, 239 aa, Zea mays
  misc_feature (44)..(44): Xaa can be any naturally occurring amino acid
  misc_feature (53)..(53): Xaa can be any naturally occurring amino acid
  misc_feature (66)..(66): Xaa can be any naturally occurring amino acid
  misc_feature (72)..(72): Xaa can be any naturally occurring amino acid
LGEQTKPALATASNERVGEGKGLGGYVKSLTDEQMEVLRKQISXYATICEQLXEMHRVLTEHQDIXAGMSVXNLYCDPLIIAGGHKITARQRWQPAPMQLQILESIFDQGNGTPSKQKIKEIAAELSQHGQISETNVYNWFQNRRARSKRKQAAASLPNNAESEAEADEEPLADKKPKSDRPPPPPPPIQDNTKATGALSADRVSGGTRHLDTGHDQTSGVMYGCNDSGSLRSSASSGV

SEQ ID NO: 9896 - protein, 701 aa, Schizosaccharomyces pombe
MEFLNIPTKNTFHWSCDPLFNELKRLSCFKSFTYENDLKTFKALRSQLCLSHPSINSLSSFQTYHQLLCVLEQKHLSECVAPFVWTLSSSSNERESFENLIFEHACLIYRLACTYHTTAISLCNEKPPNLVQACQYFQLSAGCFRYINDFYIYTKSLDFNENLLKAWEIYCLAEAQTCIFSKANSNDTTSESIIVKILAKVFLLYEDAYKLFKNATGAPSIFVHWTYIQKLFYQTITYQIISRTSYSLNKYGENISYLRLSLLHCKEALKTRFDFGFNVKVYEKLEKLESSLQFELKRNERDNDFIHLQPEIPVGSFPLLDTVTMVQSITPDVLTDKTAAYPYFSTCLDKEFMDLIEEHEKNILDAAVKSIDCLTKEGTEKLFALMEEIKSVNDNRYITETSNKVMENFTEIKNLGGLEFLRSEASSLDCLIDKVNGTYRHCCQALDEIINSVKSSQNMKEKGFYSDVIKLHEEVSLLKVNVENSQNAKDTIQKDISAFGKDIFELSAQSERILSNLAEKKNPNTDQLLLQANSYLAQWDLLKDERNMLKKLGSNDYFNISMYSNHTDIHSLLKCFREAVDAKWNFRRQRERQEIIIQNVEKLKSYLNSFKVQAECSEISKILSFSQETEKKYKFLLQTVRNETEIARELYNIICRAEERYSQYENRYENENRLNKIKLQHSSSNAFNPEIHKIKFKSSKK

SEQ ID NO: 9897 - protein, 766 aa, Gracilaria gracilis
MGSEDPHYVAWKDNKDGTACIRDDRYLEPFADALRYRYSKYSEILSAIESSEKSLENFSRGYETMGIHRVEGGVRYREWAPSAREMYFFGEFNNWDRNALPMERDEFGIWSCFIPEAEPGVSPIKHGSKVKAAVVPHQGPWLDRNPAWATFCVQDTKTFLYDTVFWDPPEKFKWTAPDHVKCPDSLRIYECHVGMGSNDLKVGSYREFADNVLPRIKETGYTALQIMAIMEHAYYASFGYHVTNFFAISSRCGIPEDLKYLIDKAHQLGLYVFMDVVHSHASSNSMDGINNFDGTDHQYFHEGERGRHSLWDSRLFNYGHWEVLRFLLSNLRWYMEEYHFDGFRFDGVTSMLYLHSGIGVQFTGNYSEYFGFQVDVDACVYMMLANKLVHDLYPDVAVTIAEDVSGMPTLCVPVDRGGLGFDYRLAMAIPDMWIEVLEKEKDENWNMGNIVFTLTNRRWNEKSIGYCESHDQALVGDKTIAFWLMDAAMYTDMSCNGYPSPAVERGIALHKMIRLLTMCLSGEGYLTFMGNEFGHPEWVDFPREGNGNSYQHARRRWDLCDNESLRYKHLYEFEKIIHALDNAHPFCRFQAHQYIVLQHEGDKLIVVEKGDRLLFVFNFHHSQSYSDYRIGTYWGGRYKLVLDSDGMNTGGHGRVHWDVVHTTRTEQWHNRPYYLQVYIPARTCQVYHCFETWEEEKEKGEKDKQTAKKSEGVVDDTKEKAGGDEKANTRVEEVSAVAAKIDEAVHLNGSQKASAKRQEKVVAGKA

SEQ ID NO: 9898 - protein, 364 aa, Zea mays
MRRWFCCTRFNASYREHENERPITPEEKEGNGFSVKSDPIKAPPSIEVPELSFEELKEKTDNFGSKALIGEGSYGRVYYAILDSGKHVAVKKLDASTDPELDNEFLTQVSIASKLKHDNFVEMLGYCVEGNQRLVVYEFATMGSLHDILHGRKGVPGAQPGPALDWMQRVKIAIDAAKGLEYLHEKVQPSIVHRDIRSSNILLFEDYRAKIADFNLSNQSPDMAARLHSTRVLGTFGYHAPEYAMAGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPAATTDATAPSDA

SEQ ID NO: 9899 - protein, 524 aa, Burkholderia mallei
MRMKLKNIGLIAAGLATGVFATLQISASAQQAVTTAAAPLPLDQLRLFAEVFGQIKREYVEPVDDKKLLTAAIKGMVSSLDPHSSYLDKTDYQELQEQTKGRFAGLGIEISQEDGLVKVISPIEDTPAFRAGIRPGDLITRINDRPVRGMTLDKAVKQMRGEPGTKVTLTIFRKSDDRTFPVTVTRAVIRVQSVKMKLLDPGYAYIRITSFQERTTPDLAAKLQDIARQQPNLKGLILDLRNNGGGLLQSAVGVAGAFLPPDSVVVSTNGQIPDSKQIYRDNYENYRLPSFDSDPLKNLPAVFKTVPMIVLTNAYSASASEIVAGALQDSHRAVIMGKATFGKGSVQTVRPMTADSALRLTTAYYYTPSGRSIQNKGILPDIPVDQYADGDPDDVLVTREVDYTNHLANTQDPNEKKELEEREQRRMEQLRILEEQNDKKTPEQRQKDRERKPIEFGSADDFMMQQALNKLEGKPVEQSKMIAADSTAKSAAAKAGAASAAKGASGAAAKPASAAKPASAPQPQ

SEQ ID NO: 9900 - protein, 115 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFVRAPGVQTPVIVRFSTVVHERASPET

SEQ ID NO: 9901 - protein, 493 aa, Unknown
  Vibrio sp. Ex25
MQTINVVWLKRDLRLTDHQPLTQALSSKHPTVLLYIVEPLLLNNPHYSERHWRFVWQSLQDMNETLKAYGHRITVLFGDALACFQSIQMQYQINAVFSHQEIGLNCTFERDKQIADWLHEQNITWFEFEHGAVIRGAKDRQGWDKHWDLVMRSSISPLDLQTNLLHSLDAESLGCAFSPPSSWLSKCKGMQTGGSQLAWKTLEDFFNRRGRDYYRSISSPTASRTACTRLSPYLAWGNISLREVYQYLLKHWQVVGFRRSLIALSSRLHWHCHFIQKFESEYDMEFYCVNRAYESLIKQSSTFDEEKLAAWKSGYTGIPLIDACMRCLHQTGYINFRMRAMLVSFLTHHMNMDWRTGVTHLAQLFLDFEPGIHYPQFQMQAGVTGTNTIRIYNPVKQAQEHDPDGAFIYKWVPELQMVPTPLLFEPWTMTQMETVMYHLKPDSRYLAPIVDLNSAAKDARERLWAWRKRADVKQEGKRILTRHVRPSKESRAR

SEQ ID NO: 9902 - protein, 643 aa, Desulfovibrio gigas
MCGIAGFVLLQDAPPVTDHQARDVLAAMAGRIAHRGPDGRGHHVGLPAAFAHCRLAIIDLSTGAQPMAAEDGAAVVTFNGEIYNYQEVRRELQALGRTFQTRSDTEVLLQAYLEWGVACLDRLEGMFAFALWDVRRRTLFAARDRFGKKPFFYTIQQGVFAFASELSALEAVPWAAFSIRASTLARFLAYEYVPTPESIYAEARKLPPAQYLELHEDGTLLVERYWETPMPRPEGSKGFGRADEPALCEELRRLLTQAVRRRLIADVPVGVFLSGGVDSSSVAAMAGQLAPGIKTFSIGFTEASYDESAYAGRVAAQLGTDHQLELLSADACADLLPEVVSRFDEPMADPSIVPTYLLSQITRRQVTVALGGDGPDELLAGYEYYPGFKATQYWERLPAWLRRAAVAASGLLPGSAGYVNPRHVAQTFLAAAEAPAWLRTQRMLTALTPEAQRALWKSPGDMLEPTRLFASTKRLWEALPDWPPMARVFHLFAQQITYGYILVKVDRCTMLHGLEARAPFLDRDLAEFCFRLPVSMKLRGATRKYLLKEAMAGLLPQDILHRPKRGFLIPTAAWLRGRLRPLVDDLLHERRLREQGLFHPAAVRRLVEEHASGKKDHRKGLWTMLVLQLWLAGKPAVRIDPER

SEQ ID NO: 9903 - protein, 139 aa, Rubrobacter xylanophilus
MPAAFIHTCYRITDPERTIDFYVNKLGMKKVGEMHFSDATNYFFAMEEDPSSPMLELTHNHDRTGPYEKGEGYSHIAFTVDDLEGTVARLAEQGVKVAVEPKTLTVDGHDYRIAFVEDPDGYRVELVQRGTMKVGDMLQ

SEQ ID NO: 9904 - protein, 444 aa, Aspergillus parasiticus
MARAGQAVDPSPLGQPLEFHFARRSAPNRFLKAGMSERMCSWTEENPSARGIPSRELIETYRTWGRGNIGAIVTGNVMIDPNHIEAEGNPTIPPNALFSGERFDQFANLAAAARANGSLILAQISHPGRQTPSHRQPEPISASDVPLDTENMGNTFAVPRAATENEIKNIITGFAHAAEFLDRAGYDGVELHAAHGYLLNQFLSRATNLRTDKYGGTLTNRMRLILEIRAAITEKVRPGFIVGIKINSVEFQPNGIVPDEACELCCALEEHRFDFVELSGGKYKNLEEDDNAKHIISKRHEAFFLDVAQKVVSSLTKMKSYLTGGFRSTAGMVDGLQTVDGIGLARPFCQEPYLCHDILRGKIPGAIIPVMDQLNYQLTVAAACIQMRQIGNKVQPVDLSSQDAVDAITAAAEGWLKRKAIDRSEEAFKPPLLSGDAAPLSVEA

SEQ ID NO: 9905 - protein, 547 aa, Unknown
  Candidatus Blochmannia floridanus
MAAKDVKFGNDARVKMLRGVNVLADAVKVTLGPKGRNVVLDKSFGAPVITKDGVSVAREIELEDKFENMGAQMVKEVASKANDSAGDGTTTATVLAQSIVNEGLKAVAAGMNPMDLKRGIDKAVVAAVEELKKLSVPCSDPKAIAQVGTISANSDETVGKLIAQAMDKVGKEGVITVEEGSGLQDELDVVEGMQFDRGYLSPYFVNKPESGTVELEHPFILLADKKISNIREMLPILESVAKSGKPLLIIAEDVEGEALATLVVNNMRGIVKVTAVKAPGFGDRRKAMLQDIAILTSGTVISEEIGLELEKATLEDMGQAKRVLITKDATTIIDGVGNKSSIDSRVAQINQQRDEATSDYDREKLQERVAKLAGGVAVIKVGAATEVEMKEKKARVEDALHATRAAVEEGVVAGGGVALIRVANAIRNLCGDNEDQNVGIKVARRAMEAPLRQIMANAGEEPSVIANNVRSGEGNTGYNAATEKYGNMIELGILDPTKVTRSALQYAASIAGLMITTECMVTELPKEDKPDLGGGNPGGAGGMGGMM

SEQ ID NO: 9906 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEELDREMGLIRTQEETGRHVRMLTHEIRSTLDRHMILKTTLVELGRTLGLEECALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKPLPDGRGSTPLKSRYQRSV

SEQ ID NO: 9907 - protein, 158 aa, Zea mays
MSLIRRSNVFDPFSLDLWDPFEGFPFGSGNSSSLFHSFPRTSSETAAFAGARIDWKETPEAHVFKADVPGLKKEEVKVEVEDGNVLQISGERNKEQEEKTDTWHRVERSSGRFLRRFRLPENAKTEQITAAMENGVLTVTVPKEDAKKPEVKSIQISG

SEQ ID NO: 9908 - protein, 148 aa, Debaryomyces hansenii
MCCCECLSDICLIVVSVFFPPLPVWIRRGLCTCDSLINILLCMLGYFPGLIHSWYIIAKYPPYAISHESKVYYVYQTRPDLENQYGGGTSRTSRDSRNPLHHHHHHHHHHREPVDNEPLPIANPTYGSTSDRNDRNETSPPAYSEIGK

SEQ ID NO: 9909 - protein, 134 aa, Zea mays
MRKHRIVSLVAALLILLALAVSSNRNAQEDSMADNTGTLVGGIQDVPENENDLHLQELARFAVDEHNKKANALLGFEKLVKAKTQVVAGTMYYLTIEVKDGEVKKLYEAKVWEKPWEKFKELQEFKPVEEGASA

SEQ ID NO: 9910 - protein, 135 aa, Coix lacryma-jobi
MRKQRIVPLVAALLVLLALAVSSTRNAREEESMADDAGMLAGGIKDVPANENDLHLQELARFAVDEHNKKANALLGYEKLVKAKTQVVAGTMYYLTIEVKDGEVKKLYEAKVWEKPWENFKELLEFKPVEEDASA

SEQ ID NO: 9911 - protein, 489 aa, Nicotiana tabacum
SKFRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHERGSPESLRDIRGFAVKFYTREGNFDLVGNNVPVFFNRDAKSFPDTIRALKPNPKSHIQEYWRILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWICSLSQADKSCGQKVASRLTLKPTM

SEQ ID NO: 9912 - protein, 378 aa, Shewanella oneidensis
MSVFTAYESGALTLQNRIVMAPMTRARTTQPGNIPNDLMVQYYAQRSSAGLIITEATQISNDSQGYSFTPGVYTEAQIDGWKKVTAAVHEAGGKIFNQIWHVGRVSHPIFQQGNAPIAPSAIAPVGTKVWIVDEAHPEGQMVDCPEPREMTQADIDRVVADFAKAGANAIAAGFDGIEIHGGNGYLIDQFLRTNSNHRTDAYGGSPEKRIRFLLEVVEAVSAQIGADKVGVRLAPYVTFKDMACPEIVETILLAAKQLSAFGVAYLHLSEADWDDAPQIPESFRIELRNVFKGSIIVAGRYDVERANDVIEKGYADLVAFGRAFIANPDLPYRLANQLPLSPFDKGPLFGGSAAGYTDYPSYQAALRAVIRSSDDEVA

SEQ ID NO: 9913 - protein, 635 aa, Gibberella zeae
MLGRSNSDINLILSLRVLQSSLRSQLQTPRNTAFLSLAKFTTMPSKRLKRESSSPSAGGTAKKAKTSKMNGSGSSDALRRPHHKAQEAEENGIAIRKFYPAEMSNARARAYNNNEIPRPIEDLVDALEVTAKERKSIDVKDAVVHWFKMDLRISDNRALALASDKAKEAGVPLIALYIISPQDYEAHLRAPVRIDFMLRTLSVIKEDLAKLDIPLYVETVEKRKHLPDRILELMDEWGASHLYANMEYEVDELRREAAMIKDFAENGKAFEVVHDTCIVPPGELHTGAGKQYAVYTPWFKTWIAHIHENLDLLELYEPPEKNPDSARKKFKKLFNAEIPEAPKSKRLGDEEKERLRSLWPCGEHEAKKRLDKFCEERIGNYHEKRNIPADAATSSLSVHLASGTISARTCVRTARDRNKTKKLNGGNDGIQTWISEVAWRDFYKHVLVNWPYVCMNKPFKPEYSNISWSYDNDHFAAWCEGRTGFPIVDAAMRQMNTIGYMHNRCRMIVASFLAKDLLLDWRKGEKYFMEHLVDGDFASNNGGWGFSASVGVDPQPYFRIFNPLLQSEKFDPDGDYIRKWVPELKDLDNKAIHDPYNRKAGPQAKKKGYPEPIVTHKDCRERALAAYKEGLAIDE

SEQ ID NO: 9914 - protein, 486 aa, Oryza sativa
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 9915 - protein, 142 aa, Arabidopsis thaliana
  misc_feature (89)..(89): Xaa can be any naturally occurring amino acid
  misc_feature (97)..(97): Xaa can be any naturally occurring amino acid
  misc_feature (101)..(102): Xaa can be any naturally occurring amino acid
  misc_feature (107)..(107): Xaa can be any naturally occurring amino acid
  misc_feature (111)..(111): Xaa can be any naturally occurring amino acid
  misc_feature (115)..(115): Xaa can be any naturally occurring amino acid
  misc_feature (117)..(117): Xaa can be any naturally occurring amino acid
  misc_feature (123)..(123): Xaa can be any naturally occurring amino acid
  misc_feature (125)..(126): Xaa can be any naturally occurring amino acid
  misc_feature (133)..(135): Xaa can be any naturally occurring amino acid
  misc_feature (137)..(137): Xaa can be any naturally occurring amino acid
  misc_feature (139)..(140): Xaa can be any naturally occurring amino acid
MASSMLSSTAVVTSPAQATMVAPFTGLKSSASFPVTRKANNDITSITSNGGRVSCMKVWPPIGKKKFETLSYLPDLSDVELAKEVDYLXRNKWIPCXFDSXXEHGIXCNRXHGNXPXYYDGRXWXXLEVSIFXXXTXSXXSF

SEQ ID NO: 9916 - protein, 474 aa, Triticum aestivum
MYHHHLQQQQQQRGESEAAASVDQDSSMSNLTTSASASANPPPPPTPASNKRKRSLPGNPDPESEVVALSPATLMATNRFLCEICGKGFQRDQNLQLHRRGHNLPWKLKQRGSKEVVRKKVYICPEASCVHHDPSRALGDLTGIKKHFFRKHGEKKWKCDKCSKKYAVQSDWKAHSKICGTREYKCDCGTVFSRRDSFITHRAFCDALTEESNKAISGGGLPLPPIAHAQHHAMLYSPHDLMQQQQHQELAAFQDHHHHHQVMQQHCNFDVKPEMQPWPTMPYDDVHHPLLQPLCSATAQSSATSVPTPTQQQQLPAAAAHLSATALLQKAAQMGATIGGAGAGGAGVHYTQMAGSATSATGSATFGLGLSCLSNQQMMSLARTASQGRSGEEGGASGGANDGMTRDFLGLRAFSHRDILGLAGFDSSCMGTAVNTGSNNTNMAPCYEPQQQGQPQPQQQQSSNEPWHGMGSHA

SEQ ID NO: 9917 - protein, 189 aa, Methylobacillus flagellatus
MDIDFKKLAPWNWFKKEQEEQQSTVSLPVQRNDLPVAGGPVSPILQLHREIDRLFDDAFRGFGFPTLAMPRWPSEWPGLLKPALDIQETDKQYKISLEVPGVEEKDIQITLDNDVLLVRGEKRQEQESKDGGFHRVERSYGSFQRALNLPADANQDTIKAAFKNGVLTITMEKREASTPKQGRSIPING

SEQ ID NO: 9918 - protein, 102 aa, Kluyveromyces lactis
GSRRASVGSMARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 9919 - protein, 623 aa, Streptomyces collinus
MSGIAGWVDFERDLTPEAPTVRAMAAALAHRGPDGFGEWIEGHAALAHRRLSLIGSEHAGQPAIVESEAGSPVAVLTLDGSVTNAVELRRELAAKGHRFTGDGDAEVALHAYLEWGAAFPERLEGLFALAVWDVRRQELLLVRDRLGVKPLCYFLTPSGVVFGSEPKALLAHPAVRPVVDADGLRELFAHSRKPGTGVFRGTREVLPGHTMTVRAPGTGHRRYWSLPARPHTDSLETTVATVRRLLSEAVATHLRADVPVGAMLSGGIDSSALTALAAHRRRAEGAGLRSFSVNFSGYAENFEPHPTMRATPDAPYAALAAEHIGTEHTEILLDTAALADPGTHAAALRSQDAPSPLGDMDVSLLLFFEALRGAGITAVLSGETADEVFNGYFWAYDPGHSNSTTFPWVSFERGHDAAAGGLGCSLVDRTLRKELDFMDYADQHYRDALTEVPQVAGESPAERRAREVTYLALTRWAPTHLDRADRMSMAHGVQLRPPFCDRALVEYVYNVPAELKRVNGQEKSLLRAAVADLLPERVLNRPKSAYPTVQEAAYGEFVRHRFEDVAADRTAPVAPLLDAEATRVALGAAAAPSGAFAWVERASMEMVLQLNTWLSEYGVELRV

SEQ ID NO: 9920 - protein, 467 aa, Listeria monocytogenes
MTSVMWFRRDLRVNDNKALYHACKEDDLLLLFQVNPAQFITGSPSHQAFFASVAHFKQEVDKTALLQIMFGEPVECLKQLKETLPSWDKVYFNRDETGYGAERDEAAKTFFDEQEIEVQAFHDSYLHSAEEVKKSPTEYYKIFTPYYKKWREEIKETPFKVTLKADNIRKENLFPKYEEQFAEMTCDLPILDSGEKTANTRLANFIKHDVADYDKARDFPELDKTSHLSRYLRTGEISVRTIWQALQENEATEGRAIFEKELCWRDFYNMIYVSFPNQKNEPIQENYRFIEWENNREFFKAWQEGKTGFPLVDAAMRQLKETGWMHNRLRMVTASFLTKDLLIDWRFGEKYFQQMLIDYDPASNIGGWQWAASTGTDAVPYFRIFNPTTQSQKFDPTGKFIRKYVKELANLPDKFIHQPEKMSEIEQKEYGLLLGKDYPFPLIDHKERRKLAIARYEFSKEHYRGNI

SEQ ID NO: 9921 - protein, 315 aa, Arabidopsis thaliana
MADEIGFFQLNTGAKIPSVGLGTWQAAPGVVGDAVAAAVKIGYQHIDCASRYGNEIEIGKVLKKLFDDGVVKREKLFITSKIWLTDLDPPDVQDALNRTLQDLQLDYVDLYLMHWPVRLKKGTVDFKPENIMPIDIPSTWKAMEALVDSGKARAIGVSNFSTKKLSDLVEAARVPPAVNQVECHPSWQQHKLHEFCKSKGIHLSGYSPLGSPGTTWVKADVLKSPVIEMIAKEIGKSPAQTALRWGLQMGHSILPKSTNEGRIRENFDVLGWSIPKEMFDKFSKIEQARLVQGTSFVHETLSPYKTLEELWDGEI

SEQ ID NO: 9922 - protein, 225 aa, Vitis vinifera
MGRGKIEIKRIENTTNRQVTFCKRRNGLLKKAYELSVLCDAEVALIVFSSRGRLYEYANNSVRTTIERYKKVCSDSSNTGSVSEANAQFYQQEASKLRRQIRDIQNLNRHILGEALSSLNFKELKNLETRLEKGISRIRSKKNELLFAEIEYMQKREIELQNSNLFLRAQIAENERAQQQMNLMPGSQYESVPQQPYDSQNLLPVNLLDPNHHYSRHDQTALQLV

SEQ ID NO: 9923 - protein, 464 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQILLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLADTPNIRTDRRRVMKEFSVNDSSSLPPPSCFTYRYFLSAFWANDENVRRALGVKKVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 9924 - protein, 544 aa, Porphyromonas gingivalis
MKRSSGSGSTLSYILIAAIFSAVGALASHFYFTHKNPSDLNEVLNLIDRNYVDSVDVRKLQHNMIPYLLEQLDPHSVFLSKADNAEEAATLSGGFCGIGVSFNTLLDTIVVTQIVPGGPSDRAGIRAGDRLLQAGSQKLYGKGVDMNTIDDVLRGEKGSVVNILIRRNGKESVHRVVRDDVPLPSLNAFYLIEPSIAYVRIDSWTGTTHAEFIEALGRLRKKGATSLILDLRENRGGLLEPAIAMANEFLGKNLPILQIEGKAYPREEISSDGKGILQQIPLVVLVDEFSASSSEVFTGAMQDHDRAQIIGRRTFGKGLVQLPFDLADGSAIRLTVARYYTPSGRSIQKPYSSGVDENYYQDLRNRFNHGELYSADSIPSLGGKIFKTAGGREVYGGGGIIPDIFIPLDTAGLNSYMMKVEDSDLIPRYAFLYSDANRVSLSRFKTVEELGAYLDRTYLIFDFASFAQRYGIPMRTSLINEARNRIKKYINAYIAMNFFDLQGYYQLLLHDDPFILQAISLIKEGKTFPLIYDQKGTQSTDPAA

SEQ ID NO: 9925 - protein, 200 aa, Oryza sativa
MVTNMTHDDYVSLCLMALAQAGVGGQWPAQKQQIDMAPPAPERELLRFRCSVCGKAFPSHQALGGHKASHRKPPTAALPMHVIDAPPPPSAEDTASSSTTTTTSGGGRHRCSVCHRTFATGQALGGHKRCHYWDGLSVVSVTASASGSGSSSVRNFDLNLKPVPETVAAGVRRWGEEEEVQSPLPFKKRRLSSPSLELNL

SEQ ID NO: 9926 - protein, 207 aa, Triticum aestivum
  misc_feature (163)..(163): Xaa can be any naturally occurring amino acid
  misc_feature (174)..(174): Xaa can be any naturally occurring amino acid
  misc_feature (192)..(192): Xaa can be any naturally occurring amino acid
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAQDGXHVEEAFQCIVXNALKNEPEEELYMPDTVXDVVGGHRGQGSSGCC

SEQ ID NO: 9927 - protein, 586 aa, Brassica oleracea
MCGILAVLGCSDDSQAKRVRVLELSRRLRHRGPDWSGIYQNGFNYLAHQRLAIIDPDSGDQPLFNEDKSIVVTVNGEIYNHEELRKGLKNHKFHTGSDCDVIAHLYEEHGENFVDMLDGIFSFVLLDTRDNSFMVARDAVGVTSLYIGWGLDGSLWVSSEMKGLHEDCEHFEAFPPGHLYSSKSGGGFKQWYNPPWFNESVPSTPYEPLAIRSAFEDAVIKRLMTDVPFGVLLSGGLDSSLVASITARHLAGTKAAKRWGPQLHSFCVGLEGSPDLKAGKEVAEYLGTVHHEFHFTVQDGIDAIEDVIYHVETYDVTTIRASTPMFLMSRKIKSLGVKMVLSGEGSDEIFGGYLYFHKAPNKQEFHQETCRKIKALHKYDCLRANKATSAFGLEARVPFLDKEFINTAMSLDPESKMIKPEEGRIEKWVLRRAFDDEERPYLPKHILYRQKEQFSDGVGYSWIDGLKAHAAENVNDKMMSKAAFIFPHNTPLTKEAYYYRMIFERFFPQNSARLTVPGGATVACSTAKAVEWDASWSNNMDPSGRAAIGVHLSAYDGSKVALPLPAPHKAIDDIPMMMGQEVVIQT

SEQ ID NO: 9928 - protein, 548 aa, Legionella pneumophila
MAKELRFGDDARLQMLAGVNALADAVQVTMGPRGRNVVLEKSYGAPTVTKDGVSVAKEIEFEHRFMNMGAQMVKEVASKTSDTAGDGTTTATVLARSILVEGHKAVAAGMNPMDLKRGIDKAVLAVTKKLQAMSKPCKDSKAIAQVGTISANSDEAIGAIIAEAMEKVGKEGVITVEDGNGLENELSVVEGMQFDRGYISPYFINNQQNMSCELEHPFILLVDKKVSSIREMLSVLEGVAKSGRPLLIIAEDVEGEALATLVVNNMRGIVKVCAVKAPGFGDRRKAMLQDIAILTKGQVISEEIGKSLEGATLEDLGSAKRIVVTKENTTIIDGEGKATEINARIAQIRAQMEETTSDYDREKLQERVAKLAGGVAVIKVGAATEVEMKEKKARVEDALHATRAAVEEGIVAGGGVALIRAQKALDSLKGDNDDQNMGINILRRAIESPMRQIVTNAGYEASVVVNKVAEHKDNYGFNAATGEYGDMVEMGILDPTKVTRMALQNAASVASLMLTTECMVADLPKKEEGVGAGDMGGMGGMGGMGGMM

SEQ ID NO: 9929 - protein, 155 aa, Arabidopsis thaliana
MDLGRFPIISILEDMLEVPEDHNNEKTRNNPSRVYMRDAKAMAATPADVIEHPNAYAFVVDMPGIKGDEIKVQVENDNVLVVSGERQRENKENEGVKYVRMERRMGKFMRKFQLPENADLDKISAVCHDGVLKVTVQKLPPPEPKKPKTIQVQVA

SEQ ID NO: 9930 - protein, 506 aa, Aspergillus nidulans
MSATKAESQKIFEKLKTKPANKTDPVFAEITQICFDCGSKNPTWSSVPFGIYLCLDCSANHRNLGVHISFVRSTNLDQWQWEQLRIMKVGGNESATKYFQSNGGSAALASKDVKVKYTSNAAVKYKEELKRRAALDAQEYPEEVVITDVPAGATSNGSSTPAGDDDDFFSSWDKPSIKRPSNPPSRTGTPPVVSRTSSPFLNAGANTARSKSPLSSDKESATASPAPTAIRASAAARKTSGTTTAKKGSVLGTKKAPKLGAKKIGGADLIDFEEAERKAKEEAERIEKLGYDPEAEEAEAAKTKTSGTGATAIASPTPLSPNKVGFGATKTTHERNSSDVERLGMGIGRLGFGQTVGSKPTAPAPKKLGFGAVGAARSAEDEEELQRTKNKFGAQKGISSDEFFGRDRFDPVAQSEAKERLRQFDGAQAISSNSYFGRPEDDYPPVDDTYGDLEAAAKDFVRRFGITAGDDLENLTQLVGDGASKLQAKRVQEFLFHNDILSLRTR

SEQ ID NO: 9931 - protein, 366 aa, Solanum tuberosum
QMGLAENQLCFDLIQEWIVNNPKASICTYEGVQDFQDIAIFQDYHGLPEFRKAVARFMEKVRGDRVTFDPERIVMSGGATGAHESLAFCLADPGDAFLVPTPYYPGFDRDLRWRTGVQLFPVVCESSNNFKVTKEALEEAYKKAQESNIKVKGLLINNPSNPLGTILDKETLKDILRFINDKNIHLVCDEIYAATAFCQPSFISISEVMNEVVGCNDDLVHIVYSLSKDLGFPGFRVGIIYSYNDVVVNIARQMSSFGLVSTQTQRLIASMLSDTIFVENFIAKSAMKLSQRHDLFTKGLGQVGITTLKSNAGLFIWMDLRRFLENSTFDNELKLWHIIINKVKLNVSPGCSFHCSEPGWFRVCFA

SEQ ID NO: 9932 - protein, 234 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEAILEDVLQPGKNMVAAGYCMYGSSCTLVLSTGSGVNGFTLDPSLGEFILTHADIKIPKKGKIYSVNEGNAKNWDGPTAKFVEKCK

SEQ ID NO: 9933 - protein, 81 aa, Methylobacillus flagellatus
MRVSAENGVLTISGERKLEKEEQGKKFHRIERAYGRFVRSFVLPDNVDPTKVTASMKDGALEVRLVKAEQAKPKQIEISVN

SEQ ID NO: 9934 - protein, 321 aa, Parasitella parasitica
MAVDYLTLDRTGDKMPLRGFGCWKIEKKDAENTIYQAIKIGYRLFDGACDYGNEVEVGRGINKAIKEGLVKREELFIVTKLWNTFHSKQHVRTAFDRQLKDWGLEYFDLYLIHFPIPLQYVDPAVSYPPEWYVPHADKLNFERSPIHECWAEMEKLVQAKLTRNIGVANFNCQAILDLLSYSKIKPAVLQIEIHPLLPQERLVKWVQEQGIQVTAYSSFGPTSYVDLCESGKTYSSLLANADVKSIANKHNVNTGQILLRYALDRNIAVIPKSVHEDRMKSNLDILNIQLDQDDRKILNSLKTNQRFNDPMIFGFGLPLFD

SEQ ID NO: 9935 - protein, 458 aa, Rhodopseudomonas palustris
MMRKTSVILLSAVTGAALTLFVTQPRTMLMGATARAATSDTYRQLNLFGDVFERVRSDYVEKPDDSKLVESAISGMLAGLDPHSSYMDAKSFRDMQVQTRGEFGGLGIEVTMEDGLIKVVSPIDDTPASKAGILANDIITNLDDEAVQGLTLNQAVEKMRGPVNTKIRLKIVRKGQDNPIEVTLVRDNIRVRSVRARVEDSDIGYIRITTFNEQTTEGLKKEIANLTNQIGADKLKGFILDLRNNPGGLLEEAVTVSDAFLDRGEIVSTRGRNAEETQRRSAHAGDLTKGKPVIVLINGGSASASEIVAGALQDHKRATVVGTRSFGKGSVQTIIPLGSGNGALRLTTARYYTPSGKSIQAKGITPDIEVMQDVPADLKARTDTKGEASLRGHLKGADGDEKTGSQSYVPPEAKDDKALKAAADLLHGIKVNASAPADKQTTGDKAAIDKPAGNKAAN

SEQ ID NO: 9936 - protein, 363 aa, Glycine max
MRRWLCCTCQVEESYPSNENEHLKSPRNYGDGNQKGSKVSAPVKPETQKAPPPIEAPALSLDELKEKTDNFGSKALIGEGSYGRVYYATLNNGKAVAVKKLDVSSEPESNNEFLTQVSMVSRLKNGNFVELHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPAPAAPES

SEQ ID NO: 9937 - protein, 713 aa, Caulobacter crescentus
MARYQGVAGDLGAAIKIMAVPELDQEAARIRALLDLGILDTPPEQEFDDIVQAARDACQAPIAVLSLIDSDRQWFKARVGIEACETERDASFCAHAVAASKTLSIPDARLDARFKDNRLVNGPEQIRSYLGAPIMTREGVAIGAVAVIDQRPRDWSSGDTQALERLARIAARLIEMRARCELADAQGQQLLNLAAEGVQFRTIFAAMREGVVLQDRSSIILRHNPAAAALLGLTHDQLLGKSSVDDDWRIVDAAGAPLPVEAQPSMVCLATGEPVLNFVLGVHLRDGALRWLSVNSLPIFDKIGEPPNLTVTSFIDVTELRERETELRDALELAERASRVKSQFVANVSHEIRTPLNGVIALASALRQSALTDRQREMVEIIVESGTTLESILSALLDLAKIEAERMELEIVSFGLEDLVRSSTDLFKIKADNKGLGFDVSVIAPPGARYRGDAQKIRQILWNLLANAIKFTDAGEIAVSVTVEGADPAAQTLLIEVRDTGVGLSPEMEHVLFEPFIQGDASATRRFGGTGLGLTICRALARMMGGDIEALARAERGSVFRVHVPVSTAEPEASVAVESEADLATAMTILLVEDNPNNRRVVELLLEPTGAELVMAENGAEALTILATQRFDLILMDMQMPVMDGLTATREVRCLEAREGEGRTPTPIVMMTANASREHRDAAFAAGADGFITKPVTPATLYAGINTALTAAA

SEQ ID NO: 9938 - protein, 405 aa, Streptococcus mutans
MMKEFNKSAKLEHVAYDIRGPVLEEADRMIANGEKILRLNTGNPAAFGLTAPDEVIRDLIMNARESEGYSDSKGIFSARKAIMQYCQLKNIPDVDVDDIYIGNGVSEMITMSMQGLLDDGDEVLVPMPDYPLWTAAVSLAGGQAVHYVCDESSNWYPDIDNIKSKITSNTKALVVINPNNPTGALYPKDVLEDIVEVARQNDLIIFADEIYDRLVMDGGEHVAIASLAPDLFCVSMNGLSKSHRIAGFRVGWMVLSGPKKHVKDYIEGLNMLSNMRLCSNVLAQQVIQTSLGGVQSIDELLLPGGRIYEQRNFIYKAMNEIPGITAVKPQAGLYIFPKIDRNMYRIDDDEQFVLNFLKQEKILLVHGRGFNWMEPDHFRIVYLPRVEELSKIQEKMTRFLGQYRK

SEQ ID NO: 9939 - protein, 371 aa, Zea mays
  misc_feature (362)..(362): Xaa can be any naturally occurring amino acid
MGSGGANTAPLLTPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRVFLANPDLPRRFEVDAPLNKYNRDTFYIPDPVIGYXDYPFLSSDV

SEQ ID NO: 9940 - protein, 259 aa, Pseudomonas syringae
MIQIHALPAFNDNYIWLLQDLSSQQCAVVDPGDAKPVLGWLTEHPDYRLTDILITHHHNDHVGGVAELKQATRARVLGPAAETIPARDVALVDHDRLTVLGLEFVVHAVPGHTLGHIAFYHEDATTPLLFSGDTLFAAGCGRLFEGTPEQMHDSLERLAKLPDSTLIYCAHEYTLSNLRFAQAVEPDNQDIAQRLAEVIRWRSENRISLPSNLALEKRTNPFLRTRETSVKEKADERSSGQNTSQSAVFASLRAWKDKF

SEQ ID NO: 9941 - protein, 549 aa, Yersinia enterocolitica
MAAKDVKFGNDARIKIVRGVNILADAVKVTLGPKGRNVVLDKSFGSPTITKDGVSVAREIELEDKFENMGAQMVKEVASKANDAAGDGTTTATVLAQSIITEGLKAVAAGMNPMDLKRGIDKAVIAAVEELKKLSVPCSDSKAIAQVGTISANSDSTVGELIAQAMEKVGKEGVITVEEGSGLQDELDVVEGMQFDRGYLSPYFINKPETGSIELESPFILLADKKISNIREMLPVLEAVAKAGKPLLIIAEDVEGEALATLVVNTMRGIVKVAAVKAPGFGDRRKAMLQDIATLTAGTVISEEIGLELEKTTLEDLGQAKRVVINKDTTIIIDGVGDEAAIQGRLAQIRQQIEEATSDYDKEKLQERVAKLAGGVAVIKVGAATEVEMKEKKARVEDALDATRAAVEEGVVAGGGVALIRARSAITAAGLKGDNEDQNVGIKVALRAMESPLRQIVVNAGEEASVIANNVKRVQVATVTSYSEEYGDMIAMGILDPTKVTRSALQYAASIAGLMITTECMITDLPRDDKGADMGAGGMGGMGGMGGMM

SEQ ID NO: 9942 - protein, 738 aa, Passiflora edulis
MESCNCIEPQWPAEELLMKYQYISDFFIALAYFSIPLELIYFVKKSAVFPYRWVLVQFGAFIVLCGATHLINLWTFTMHSRTVATVMTIAKVLTAVVSCATALMLVHIIPDLLSVKTRELFLKNKAAELDREMGLIRTQEETGRHVRMLTHEIRSTLDRHTILRTTLVELGRTLALEECALWMPTRTGLELQLSYTLRQQNPVGYTVPIQLPVINQVFSTNRAVKISPNCPVARLRPLAGKYVPGEVVAVRVPLLHLNNFQINDWPELSTRRYALMVLMLPSDSARQWRVHELELVEVVADQVAVALSHAAILEESMRARDLLMEQNVALDLARREAETAIRARNDFLAVMNHEMRTPMHAVIALSSLLQETELTPEQRLMVETILKSSNLLATLINDVLDLSKLEDGSLQLDSGTFNLHAVFREVLNLIKPIASVKKLLLLLNLAPDLPEYAVGDEKRLIQIILNIVGNAMKFSKEGSISITAIVAKLESLRDARVPDFFPTPSENHFYLRVQVKDSGVGINPQDIPKLFIKFAQTQTTGARNSSGSGLGLAICRRFVNLMDGHIWLESEGLGKGCTAIFIVKLGIPERLNESKPPFMSKVAVDHGQTTFPGLKVLLMDDNGVSRMVTKGLLLHLGCDVTTVGSSEECIRVASQDHRVVFMDVGMPEGFEAAVRLHEKFTKRHERPLVVALTASTDRMTKENCMRVGMDGAILKPVSVDKMRSVLSDLLEHKVLFEC

SEQ ID NO: 9943 - protein, 239 aa, Brassica oleracea
RGRVQLKRIENKINRQVTFSKRRSGLLKKAHEISVLCDAEVALIVFSSKGKLFEYSTDSCMESILERYDRYLYSDKQLVGRDISQIENWVLEHAKLKARVEVLEKNKRNFMGEELESLSLKDLQSLEHQLDAAIKSIRSRKNQAMFESISALQKKDKALQDHNNTLLKKIKEREKKTGHQEGQLNHCSNNSSIVQPQYCLTSSRDGFVGRVGGENGGASSLTEPNSLLPAWMLRPTTNE

SEQ ID NO: 9944 - protein, 434 aa, Cytophaga hutchinsonii
MRNKILSDGAKELSYEIREIVKKADLINKNGQSIVFENIGDPIQKNNVVPQWIRETISNLTLDNKSYSYSPSKGILKTRQFLAELNNKKAGAQITADDILFFNGLGDAIAKVYQFISRSSRVIGPSPAYSTHSSAEAAHASQDPITYKLDPNNHWYPDLDDLYNKVKYNPNIIGILIINPDNPTGMVYPLETLKRIVEIAREFNLFLLSDEIYLNITYNGARAYSLAEVIEDVPGIAMKGISKEFPWPGSRCGWMEYYNRGKDQDFDKFCSALDNAKMIEVCSTTLPQLAIPVIMSDPRYLPYREELNSKIGKRSKIIAGILGQIPELMFNETYGAFYNTIVFKDGVLNDKQTLPIENAANKALVEKWISEPNVDLDKRFVYYLLAAKGICVVPISSFCSDLKGFRVTLLEENEELLEQTFTSIRDAIRLYLKS

SEQ ID NO: 9945 - protein, 296 aa, Pseudomonas putida
MAGKSPLINLNNGVKMPALGLGVFAASAEETASAIASAISSGYRLIDTARSYNNEAQVGEGIRNSGVDRAEMFVTTKLFNCDYGYERALRAFDESLGRLGLDYVDLYLLHWPTKDWNATIQSWKAAEKILGDGRARAIGVCNFLEDQLDELIAASDVVPAVNQIELHPYFAQKPLLAKNRALGIVTEAWSPIGGAINDGDGDNHGGRKHPLTDPVITTIAEAHGRSAAQVILRWHFQNDVVAIPKSVNPERIAKNIDVFDFALSDAEMAQLDELDTGVRIGPDPRDVDTSSFAEFV

SEQ ID NO: 9946 - protein, 635 aa, Oryza sativa
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEIRSTLDRHTILRTTLVELGRTLALAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICACNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPHALRGPHEPDYHPVVSDGFLYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 9947 - protein, 241 aa, Brassica oleracea
MGRGRVQLKRIENKINRQVTFSKRRSGLLKKAHEISVLCDAEVALVIFSSKGKLFEYSTDSCMERILERYDRYLYSDKQLVGREISQSENWVLEHAKLKARVEVLEKNKRNFMGEDLDSLSLKELQSLEHQLHAAIKSIRSRKNQAMFESISALQKKDKALQDHNNALLKKIKEREKNTVQQGGQLIQCSNNASILQPQYCLTSSRDGFVGRVGEENGVASLLAEPNSLLPAWMLRPTTKE

SEQ ID NO: 9948 - protein, 501 aa, Sinapis alba
DEEITCQENLPFTCGNTDALNSSSFSSDFIFGVASSAYQIEGTIGRGLNIWDGFTHRYPNKSGPDHGNGDTTCDSFSYWQKDIDVLDELNATGYRFSIAWSRIIPRGKRSRGVNEKGIDYYHGLISGLIKKGITPFVTLFHWDLPQTLQDEYEGFLDPQIIDDFKDYADLCFEEFGDSVKYWLTINQLYSVPTRGYGSALDAPGRCSPTVDPSCYAGNSSTEPYIVAHHQLLAHAKVVDLYRKNYTHQGGKIGPTMITRWFLPYNDTDRHSIAATERMKEFFLGWFMGPLTNGTYPQIMIDTVGERLPSFSPEESNLVKGSYDFLGLNYYFTQYAQPSPNPVNSTNHTAMMDAGAKLTYINASGHYIGPLFEKDKADSTDNIYYYPKGIYSVMDYFKNKYYNPLIYVTENGISTPGDENRNQSMLDYTRIDYLCSHLCFLNKVIKEKDVNVKGYLAWALGDNYEFNKGFTVRFGLSYIDWNNVTDRDLKKSGQWYQSFISP

SEQ ID NO: 9949 - protein, 243 aa, Brassica oleracea
MGRGRVQLKRIENKINRQVTFSKRRSGLLKKAHEISVLCDAEVALVVFSSKDKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGASSLIGPNSLLPAWMLRPATNE

SEQ ID NO: 9950 - protein, 437 aa, Corynebacterium efficiens
MTTKKRNTSETTDTAPKAVGADQAARPVRRTTRRIFDQSEKMKDVLYEIRGPVAAEAERMELDGHNILKLNTGNPAVFGFDAPDVIMRDMIAALPTSQGYSTSKGIIPARRAVVTRYEVIPDFPNFDVDDVFLGNGVSELITMTMQALLNDGDEVLIPAPDYPLWTAATSLSGGKPVHYLCDEDNEWNPSIEDIRSKITEKTKAIVVINPNNPTGAVYSRKVLQEIADIAREYDLLVLADEIYDRILYDDAQHINMATLCPDLMCITYNGLSKAYRVAGYRAGWMIITGPKRYAKGFIDGLELLAGTRLCPNVPAQHGIQVALGGRQSIYGLTGEGGRLLNQRNVAWQKLNEIPGVSCYKPMGALYAFPRLDPNVYEIHDDTQLMLDILRSEKILLVQGTGFNWPHHDHFRVVTLPWASQLENAIERLGNFLVSYKQ

SEQ ID NO: 9951 - protein, 242 aa, Brassica oleracea
MGRGRVQLKRIENKINRQVTFSKRRSGLLKKAHEISVLCDAEVALVVFSSKGKLFEYSTDSSMERILERYDRYLYSDKQLVGRDISQSENWVLEHAKLKARVEVLEKNKRNFMGEDLDSLSLKELQSLEHQLDAAIKSIRSRKNQAMFESISALQKKDKALQDHNNTLLKKIKEKEKEKNTGQQEGQLIQCSNNSSVLQPQYCVTSSRDGLVERVGGENGGTSSLIEPNSLLPAWMLRPTTK

SEQ ID NO: 9952 - protein, 227 aa, Nicotiana sylvestris
MAVKNKVSNGDLKGGNVKTNGVKEVHYRGVRKRPWGRYAAEIRDPGKKSRVWLGTFDTAEEAAKAYDTAAREFRGPKAKTNFPLPSENQSTSHSSTMESSSGETGIHAPPHAPLELDLTRRLGSVAADGGDNCRRSGEVGYPIFHQQPTVAVLPNGQPVLLFDSLWRPGVVNRPQPYHVMPMAMGFNGVNAGVDPTVSDSSSVVEENQYDGKRGIDLDLNLAPPTEF

SEQ ID NO: 9953 - protein, 473 aa, Unknown
  Exiguobacterium sp. 255-15
MKKSTTAVIAVSTFGLGLGAGAVGMLAAGGTDSVATSSSSNATGDWKKIDQVRQMISQNYLEDVTDQELLEGALTGMTEVLDDPYSVYMDESETASFNTNLSSSFEGIGATLEQKGESIVIVSPIKGSPAEKAGIKPGDIILEIDGKSTKGQKTDQAVKKIRGEKGTKVVLMIQRGGQDPMKISIVRDTIPIETVYSKTEKVNGKTIGVLQVTQFSDPTAKEFEKQLAALEEKNIDGLVIDVRGNPGGLLTAVSQMIAPFIPKDTPIFQVEDNKGERTQEFGKAEEKKPYKLVVLEDSGSASASEILAAGLKEGAGAEVVGTKSFGKGIVQSAYDLKDGSDLKLTTNKWLTPDGNWIHKKGVKPTVEVKQPDYFNVTKILTDNKTLASGDYGKPVENAHLVLEAIGFDPKGQDGYFGDTMKQAVERLQKDAKLEVTGKINQVTASEMETRLLKKLEDEKNDVQRIKALEVAAQ

SEQ ID NO: 9954 - protein, 400 aa, Arabidopsis thaliana
MTKKMRRVGKYEVGRTIGEGTFAKVKFARNTDTGDNVAIKIMAKSTILKNRMVDQIKREISIMKIVRHPNIVRLYEVCLFVSMHLRNFISEVLASPSKIYIVLEFVTGGELFDRIVRNFHTCRQRPLVHKGRLEESESRKYFQQLVDAVAHCHCKGVYHRDLKPENLLLDTNGNLKVSDFGLSALPQEGVELLRTTCGTPNYVAPEVLSGQGYDGSAADIWSCGVILFVILAGYLPFSETDLPGLYRKINAAEFSCPPWFSAEVKFLIHRILDPNPKTRIQIQGIKKDPWFRLNYVPIRAREEEEVNLDDIRAVFDGIEGSYVAENVERNDEGPLMMNAFEMITLSQGLNLSALFDRRQDFVKRQTRFVSRREPSEIIANIEAVANSMGFKSHTRNFKVT

SEQ ID NO: 9955 - protein, 277 aa, Unknown
  Synechococcus sp. PCC 7002
MTVATSQKLPLDWTTIIYFSLIHLVALLAFLPGNFSWQAVGVFLLFHWITGGIGITLGFHRLVSHRSFEVPKWLEYFLIFCGTLACQGGPIDWIGLHRIHHKHSDNTPDPHDSNKGFWWSHIGWMLFEIPARGDIDRYIKDIKDDPFYNFCQKYMVLIQVALGLALYAWGEAWVGNGWSFVIWGVFLRLAVVFHCTWFVNSATHKFGYKSHESNDHSKNCWWVALVTYGEGWHNNHHAYQYSARHGLNWWEIDMTWMTIRFLQALGLAKNIRLAPAK

SEQ ID NO: 9956 - protein, 477 aa, Bdellovibrio bacteriovorus
MKKTLTTSAGIPISENQHSLTSGPRGPVALQDYHLIEKLAHFNRERIPERVVHAKGSGAYGTFTVTHDITRFTKAAIFSKIGKKTEAFLRFSTVAGEKGSADTERDPRGFALKFYTEEGNWDIVGNNTPVFFERDPLKFPDFIHSQKRDPQTGYKNPVRMWDYWSKAPEALHQITILFSDRGIPDGYRFMNGYGSHTFSFINDKNERVWVKFHFKSMQGIKNLPVAKAVELAGTDPDYAGRDLFEAIERKEFPRWALKVQIMTERQAEQFRFDPFDLTKVWPHSEFPLLDVGILELNRNPENYFAEVEQAAFSPSNVPPGVGFSPDKMLQGRLFAYPDAQRYRLGVNYQYLPVNRPHSEVNSYHRDGSMRFDGNGGRQDNYEPNGFGGPVQNESFKDPALNLSGTLDRHDSHKDNDDFTQAGNLYRMLSEEEKDRLTSNIAGTMKTISEDLQTKNIEHFKRCDPDYGGRIAAKLGLD

SEQ ID NO: 9957 - protein, 765 aa, Sclerotinia sclerotiorum
MNRYDDGELEISLAPSANHRAQHRSSEASSNPRRDSQNGGNRRMESAPQKKTEQRVGAYSVVRTLGEGSFGKVKLAVHRVTQQQVALKIIARRKLISRDMAGRVEREIEYLQLLRHPHIIKLYTVIKTPHEIIMVSEYAGNELFDYIVQHGKMREDEARRFFQQIICAVEYCHRHKIVHRDLKPENLLLDENLNVKIADFGLSNIMTDGNFLKTSCGSPNYAAPEVINGKLYAGPEVDVWSCGVILYVLLVGRLPFDDEHIPSLFAKIARGQYNVPSYMGREAAALIKKMLAVNPVYRATIAEIRDDPWFTTNLPAYLQPPVEEFIDTGVDPAKAINPRAIAPHASPAIQEKLHVQVTEKISKTMGYGIKDVQEALAAEEPSAIKDAYLIVRENKLMQANPNLTDDKNQLLFQIPSPPTYDSTIPPSMPDSPSPLVKERPGNIPPTAPPFQPRPSPLLDAVSPRSSSSIGTDRSFVRPYVSKIGILPSSIPQYHKEFMETHKSGHQESTLSNSHSETIEPSPQTEAEKAETVRRLNPHSRSLAKLDEGKKPAGMTPVPVKKAKPTKWQFGIRSRNQPLEAIGCIYRALQKLGAEWLVGDEWTPGQSENNGNKRNDDNDDNDDPNGSGASLHRETSMNDNSKKNRFSGIDKKGNYKLPEDPWVLHVRWKKTDIRRHSIASLNSSTSSPAHPSSMPKDEGLDSIDGGVIMHLDIQLYEMEPGVYLVDFKCAGYETADGMMCEEKDVTSPFPFLDLASKLIIQLAEAD

SEQ ID NO: 9958 - protein, 265 aa, Colwellia psychrerythraea
MTNSHQIVTAINAFNDNYIWAISSQNNDKIALVDPGDAVVCIKYLQENNLALSAILITHHHSDHVGGIEKLLEYSKDKAWPVTVYGPATEKIAQLDITLKENDTVDLTELDCQFTVLDLPGHTKGHIAYYNDKMVFCGDTLFSGGCGRLFEGTPQQMHHSLTKLANLATDTLIYCAHEYTQANLAFALAVEPNNTDLHNYAEQVKVKRQQNQATIPTNIALELQINPFLRCHEESIKLAAQTYSNQNQPNDSEVFSAIRAWKDNF

SEQ ID NO: 9959 - protein, 250 aa, Zea mays
  misc_feature (222)..(222): Xaa can be any naturally occurring amino acid
MAATVAVDNLNPKVLKCEYAVRGEIVIHAQRLQEQLKTQPGSLPFDEILYCNIGNPQSLGQQPVTFFREVLALCDHPDLLQKEEIKTLFSSDSISRAKQILAMIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSGGIDVRXALVVINPGNPTGQVLAEENNMDIVKFCK

SEQ ID NO: 9960 - protein, 729 aa, Xanthomonas campestris
MAEGGGGSAVALQDLQAIAAGLPGDAFAVLGPHVQADGRLRVRVLAPGAEALGLIDGRGKLLARMQASPIDGVFEGELPADAAYRLRIVWPDVVQEIEDPYAFAPQIDESALLQIGAGDGQALRANLGARHVQVGELPAVRFAVWAPHAQRVAVVGDFNGWEPRRHPMRQRSGGIWELVLPRVETGARYKYAIITADGRVLLKADPVARQSELPPATASVVASADAFAWTDAEWMARRSAAAEPAPLSIYEVHAASWRRDGHDQPLDWVSLAAQLIPYVQELGFTHIELLPITEHPFGGSWGYQPLGLYAPTARHGSPDGFAQFVDACHRAGIGVILDWVSAHFPDDAHGLSQFDGSATYEHADPREGMHRDWNTLIYNYGRPEVTAYLLGSAMEWIAHYHLDGLRVDAVASMLYRDYGRAEGEWVPNAHGGRENLEAVAFLRQLTGEIASQFPGVLTIAEESTAWPGVTAPISEGGLGFTHKWNMGWMHDTLHYMQRDPAARAQHHSQLTFGLVYAFSERFVLPLSHDEVVHGTGGLLGQMPGDDWRRFANLRAYLALMWAHPGDKLLFMGAEFGQWADWNHDRSLDWHLLDHAPHRGMQQLVRDLNRALRRVPALYRGNHRADGFEWSVADDARNSVLAFIRHDPDGGAPLLAVSNLTPQPHHDYRVGVPRAGGWREILNTDSAHYGGSNLGNGGRLLTEPTGMHGHAQSLRLTLPPLATIYLQAEK

SEQ ID NO: 9961 - protein, 585 aa, Xanthomonas campestris
MIERNVTTPAWGAWPAGDGQVRFALWAPDAHTVEVIFDSGERAALQRQDDGFFSGVVACALDARYRYRVDGQTPVPDPASRWQPDGVHGSSAVQRVDGYHWTHTQWQGRPWDEAVIYELHVGACGGYAGVQAQLPQLAAMGITAIELMPLSAFPGAHNWGYDGVLPYAPAEAYGTPDELKALIDAAHGHGLMVLLDVVYNHFGPDGNYLGSYASAFFNEDKPTPWGAAIDFRKPPVQRYFLDNALMWLHEYGFDGLRLDAVHAITPNAFLDTLRETIEASLPAGRHVHLVLENEANQASQLDRGYTAQWDDDFHNALHVLLTGEEEGYYAAFADQPTQHLARVLGEGFAYQGQPDPRGHVRGEPSGALPPHKFVIFAQNHDQIGNRACGERLSVLVSPQRLRAALALTALTPMIPLFFMGEPWGATQPFLFFTDFGPPLDDAVREGRRREFAHFAAFADPAKRETIPDPNSHATFAASRAPIEDAAHGDGAQWAAWFQALLGVRRQWLVPGLAQARALRASVLADGAVTATWELPGGLWHIAFNVGAEAVPLPPLRGRVAHAENVTADAQTLPTDSFIAWYEEHA

SEQ ID NO: 9962 - protein, 361 aa, Leifsonia xyli
MATLFGPLTLRGVTARNRIWASPMCMYSVLDRSGVPQTWQLVHLGAIATGGSGIVFTEATAVSPEGRISPRDTGIWTDEQAEAWRPIAAFIAEQGAVPGIQLAHAGRKASSWPAWGFEDRTGSVPAAEGGWPTVAPSPIAFGDLDTPAELDRSGIDRVVAGFRSSARRSVDAGFRVLELHAAHGYLLHQFLSPLANRRDDEYGGSLENRARLLLRIVAEVRTEVGGDVPVFVRFSGSDWTPGGWDEQQTATVAGWAQEAGADFFDISSGGIQTGVRIPLQPGYQVPFAEHVRRSAEVEVSAVGLITTPRQAADIVENGSADAVMLARELLRDPHFPLRAAHELGVPIGYWPPQYLRAAWRG

SEQ ID NO: 9963 - protein, 245 aa, Tontelea attenuata
ALSIAGAVQSQKLAVRAISQIQSLPGGDIKLLCDTVVESVRDLTGYDRVMVYKFHEDEHGEVVAESKRPDLEPYIGLHYPATDIPQASRFLFKQNRVRMIVDCHASPVRVIQDDGLMQPLCLVGSTLRAPHGCHAQYMENMGSIASLAMAVIINGNDEEVIGGRNPTRLWGLVVCHHTSARCIPFPLRYACEFLTQAFGLQLKMELQLAAQLLEKHVLKTQTLLCDMLLRDSPTGIVTQSPSIMD

SEQ ID NO: 9964 - protein, 194 aa, Yarrowia lipolytica
MADSDSKPSSGNELELREQDKWLPIANVARIMKSALPENAKVSKEAKECMQECVSEFISFITSEASEKCAAEKRKTVNGEDILFAMLSLGFENYAEALKIYLTKYRQNQNYKQENRSENRKKKTLPAQEGAVAAAATGSNPVTETNSPSQQQQEEYYAAYDVPINGQDPTEQRFSEEPTQDEKAMYDAYTGDYY

SEQ ID NO: 9965 - protein, 245 aa, Tontelea attenuata
ALSIAGAVQSQKLAVRAISQIQTLPGGDIKLLCDTVVESVRDLTGYDRVMVYKFHEDEHGEVVAESKRPDLEPYIGLHYPATDIPQASRFLFKQNRMRMIVDCHASPVRVIQDDGLMQPLCLVGSTLRAPHGCHAQYMENMGSIASLAMAVIINGNDEEVIGGRNPTRLWGLVVCHHTSARCIPFPLRYACEFLMQAFGLQLKMELQLAAQLLEKHVLKTQTLLCDMLLRDSPTGIVTQSPSIMD

SEQ ID NO: 9966 - protein, 374 aa, Tripterygium regelii
ALSIAGAVQSQKLAVLAISQLQSLQGGDIKLLCDTVVESVRDLTGYDRVMVYKFHEDEHGEVVAESKRPDLEPYIGLHYPATDIPQASRFLFKQNRVRTIVDCHALPVRVIQDDGLMQPLCLVGSTLRAPHGCHAQYMKNMGSMASLAMAVVINGNDEEVIGERNTTRLWALVVCHHTSARCIPFPFRYACEFLMQAFGLQLNMELQLAAQLMEKHVLKTRTLLCDMLLRDPPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPEDKDDGQRMHPRSSFKAFLEVVKSRSLPWEN

SEQ ID NO: 9967 - protein, 256 aa, Brassica oleracea
MGRGRVQLKRIENKINRQVTFSKRRAGLFKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRSRKNQLMYDSVNELQRKEKAIQEQNSMLSKQIKEREKVLMAQQEQWDQQNHGQNMPSPPPPQQHQIQHPYMLSHQPSPFLNMGGLYQEEDPMAMRRNDLDLSLEPVYNCNLGCFAA

SEQ ID NO: 9968 - protein, 371 aa, Tripterygium regelii
ALSIAGAVQSQKLAVLAISQLQSLQGGDIKLLCDTVVESVRDLTGYDRVMVYKFHEDEHGEVVAESKRPDLEPYIGLHYPATDIPQASRFLFKQNRVRTIVDCHALPVRVIQDDGLMQPLCLVGSTLRAPHGCHAQYMENMGSMASLAMAVVINGNDEKVIGGRNTTRLWGLVVCHHTSARCIPFPLRYACEFLMQAFGLQLNMELQLAAQLMEKHVLKTRTLLCDMLLRDSPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPEDKDDGQRMHPRSSFKAFLEVVKSRSLP

SEQ ID NO: 9969 - protein, 242 aa, Elaeis guineensis
MGRGRVELKRIENKINRQVTFAKRRNGLLKKAYELSVLCDAEVALIIFSNRGKLYEFCSSSSMMKTLERYQKCNYGAPETNIISRETQSSQQEYLKLKARAEALQRSQRNLLGEDLGPLSSKELEQLERQLDASLKQIRSTRTQYMLDQLADLQRKEQMLCEANKSLRRRLEESNQAGQQQVWDPTAHAVGYGRQPPQPQSDGFYQQIDSEPTLQIGYPPEQITIAAAPGPSVNTYMPGWLA

SEQ ID NO: 9970 - protein, 374 aa, Tripterygium regelii
ALSIAGAVQSQKLAVLAISQLQSLQGGDIKLLCDTVVESVRDLTGYDRVMVYKFHEDEHGEVVAESKRPDLEPYIELHYPATDIPQASRFLFKQNRVRTIVDCHALPVRVIQDDGLMQPLCLVGSTLRAPHGCHAQYMENMGSMASLAMAVVINGNDEEVIGGRNTTRLWGLVVCHHTSARCIPFPLRYACEFLMQAFGLQLNMELQLAAQLMEKHVLKTRTLLCDMLLRDSPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPGDKDDGQRMHPRSSFKAFLEVVKSRSLPWEN

SEQ ID NO: 9971 - protein, 126 aa, Debaryomyces hansenii
MSKISDTALHNSDYEIKEQDRFLPIANVGRVMKKALPPHAKLSKESKECIQECVSEFISFITSHASDRGRLEKRKTLNGEDILWSMYILGFENYSETLKIYLAKYRQVCIFIHSVFIREAITKTLV

SEQ ID NO: 9972 - protein, 242 aa, Elaeis guineensis
MGRGRVELKRIENKINRQVTFAKRRNGLLKKAYELSVLCDAEVALIIFSNRGKLYEFCSSSSMMKTLERYQKCNYGAPETNIISRETQSSQQEYLKLKARVEALQRSQRNLLGEDLGPLSSKELEQLERQLDASLKQIRSTRTQYMLDQLADLQRREQMLCEANKSLRRRLEESNQAGQQQVWDPTAHAVGYGRQPPQPQSDGFYQQIDGEPTLQIRYPPEQITIAAAPGSSVSTYMPGWLA

SEQ ID NO: 9973 - protein, 256 aa, Brassica oleracea
MGRGKVELKRIENKINRQVTFAKRRNGLLKKAYELSVLCDAEIALLIFSNRGKLYEFCSNPSGMAKMVEKYRKHSYATMDPNQSAKDLQERYQDYLNLKSRVEVLQHSQRHLLGEEIAGIGVDELEQLECQVDTSLRQIRSTKARSMLDQLSDLKSKEEMLLETNRDLKRKLEESDAALNQTLWGASSSAEHSQQQQEGMTSYHANPLSQEVGFFRPLQGNVALQMSHYNPGVPNASNSATTSQNVINGFFPGWMV

SEQ ID NO: 9974 - protein, 250 aa, Brassica oleracea
MGRGRVELKRIENKINRQVTFAKRRNGLLKKAYELSVLCDAEVALIIFSNRGKLYEFCSSSNMIKTLERYQKCSYGSIEVNNKPAKELENSYREYLKLKGRYEGLQRQQRNLLGEDLGPLNSKELEQIERQLDGSLKQVRSIKTQYMLDQLSDLQTKEQMLLETNRALAMKLDDMIGVRSHHMGGGGGGWEGNEHNVSYAHHQAQSQGLFQPLECNPTLQMGYDNPVCSEQITATTQAQAQPGYIPDWML

SEQ ID NO: 9975 - protein, 479 aa, Zea mays
MARRRPMDYEELNEKVKKAQYAVRGELYLRASELQKEGKKIIFTNVGNPHALGQKPLTFPRQVVALCQAPFLLDDPNVGLMFPPDAIVRAKRYLAMAPGGLGAYSDARGIPGIRKEVADFIHKRDGYPSDPELIYLTDGASKGVMQMLNAIIRNERDGILVPVPQYPLYSAIISLFGGSLVPYYLEEEANWNLDFANIRQAVAEARSKGITVRATVIINPGNPTGQCLSEANIRELVRYCYHENLVLLADEVYQQNVYQDERPFISARKVMFDMGPPISREVQLVSFHTVSKGYWGECGQRGGYFEMTNLPPKTVDEIYKVASIVLSPNVPGQIFMGVMVNPPKPGDISYPKFTAESKSILESLRRRARMMTDGFNSCRNVVCNFTEGAMYSFPQIQLPARAIEAAKRAGKAADVFYCLKLLEATGISTVPGSGFGQKEGVFHLRTTILPAEEDFPTIMSSFKKFNDSFMEQYEGYSRM

SEQ ID NO: 9976 - protein, 242 aa, Elaeis guineensis
MGRGRVELKRIENKINRQVTFAKRRNGLLKKAYELSVLCDAEVALIVFSNRGKLYEFCSSSSMLKTLERYQKCNYGAPETNIVSRETQTSQQEYLKLKARVEALQRSQRNLLGDDLGPLSSKELEQLERQLDASLKQIRSTRTQYMLDQLADLQRREQMLCEANKSLKQRLEESNQATQQQVWDPNAPAVGYGRQPPQPQGDGFYQQIECDPTLHIGYPPEQITIAAAPGPSVSNYMPGWLA

SEQ ID NO: 9977 - protein, 91 aa, Glycine max
  misc_feature (45)..(45): Xaa can be any naturally occurring amino acid
  misc_feature (51)..(51): Xaa can be any naturally occurring amino acid
  misc_feature (80)..(80): Xaa can be any naturally occurring amino acid
MSRKIESLGVERVISGEGSHGMFGGYLYFSKAPSKEEFLPEAMRXIKALLXYDCLRATRSTFDRGLEARVPFLNKECYEXAMNIDPQCAMI

SEQ ID NO: 9978 - protein, 206 aa, Cucumis sativus
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVLGNKVDVDGGNSRVVSEKKARAWCASKGNIPYFETSAKEGINVEEAFQCIAKNALKSGEEEEIYLPDTIDVGSNNQPRSSGCDC

SEQ ID NO: 9979 - protein, 346 aa, Brassica napus
  misc_feature (161)..(161): Xaa can be any naturally occurring amino acid
STHASAGLKPMRHPYSLSVGQSVFRPGRVTHALNGDALAQALMDSNHPTGGLANYEEWTIDLRKLHMGPAFAQGAFGKLYRGTYKGEDVAIKLLERPENSPEKAQALEQQFQQEVSMLAFLKHPNIVRFIGACVKPMVWCIVTEYAKGGSVRQFLTKRQNXAVPLKLAVKQALDVARGMDPRDERNFIHRDLKSDNLLISADRSIKIADFGVARIEVQTEGMTPETGTYRWMAPEMIQHRPYTQKVDVYSFGIVLWELITGLLPFQNMTAVQAAFAVVNRGVRPTVPADCLPVLGEIMTRCWDANPEVRPCFAEVVNLLEAAETEIMTTARKARFRCCMTQPMTID

SEQ ID NO: 9980 - protein, 788 aa, Streptomyces coelicolor
MTPRPSSSGPDPRKTTGKKPAGKTPTGKKPAKAAKKKAPRRTTASANASATTSVSGAEVAVSPAPDAADRERLLAGTHHDPHAVLGAHRVPGGVAFRVFRPYALAVTVLSGELRVGLHDDGDGFFSGLVPLKDVPAHRLLVAYEGREQEVEDPYRFLPTLGELDLHLLGEGRHEQLWRALGAHPTTHEGVAGTRFAVWAPNARGVRVAGGFNFWDGTGHPMRSLGSTGVWELFLPGVGAGELYKFEITRPDGSRTFRADPLARRTEVPPATSSVVHASDYTWGDEEWLAHRADAPAHEAPMSVYEVHLPSWRPGLTYRQLAEQLPAYVADLGFTHVELMPVAEHPFGGSWGYQVTGFYAPTARLGDPDDFKYLVDRLHRAGIGVLMDWVPAHFPRDDWALAEFDGRPLYEHSDPLRAAHPDWGTLEFDFGRREVRNFLVANAVYWCEEFHIDGLRVDAVASMLYLDYSREPGEWEPNEHGGRENLDAVAFLQEMNATLYRRVPGVVTVAEESTAWDGVTRATHHEGPSGFGGLGFGLKWNMGWMHDSLDYMSHEPVHRKHHHGEMTFSMVYAYSENYVLPISHDEVVHGKRSLVSKMPGDWWQQRANERAYLGFMWAHPGKQLLFMGQEFAQGAEWSEAHGPDWWLLDPEYGASADHRGVRDLVRDLNTVYRATPALWRRDTHPSGFSWVVGDAAEDNVLAFLRLDADGTPLLAVSNFAPVVRSGYRLGVPDEVPAWHEVLNTDAARYGGGDVVNPDPVKPEPQGWHGRPASIRLTLPPLATVWLRPA

SEQ ID NO: 9981 - protein, 472 aa, Bartonella birtlesii
LREVASKTNDIAGDGTTTATVLGQAIVQEGVKAVAAGMNPMDLKRGIDSAVAEVVESLFKKAKKIQTSAEIAQVGTISANGASEIGKIIADAMDKVGNEGVITVEEAKTAETELEVVEGMQFDRGYLSPYFVTNAEKMVADLDDPYILIHEKKLSNLQSLLPVLEAVVQSGKPLLIIAEDVEGEALATLVVNKLRGGLKICAVKAPGFGDRRKAMLEDIAILTSGQVISEDVGIKLENVTLDMLGRAKKVHISKENTTIVDGSGQKAQISARVSQIKAQIEETTSDYDREKLQERLAKLAGGVAVIRVGGATEVEVKEKKDRVDDALNATRAAVEEGIVAGGGTALLRAANAITVKGSNADQEAGINIVRRALQAPARQIATNAGEEAAIIVGKVLENNSDTFGYNTATGQFGDLISLGIVDPVKVVRSALQNAASIASLLITTEAMVAELPKKETPMPPMGGGRNGWNGRN

SEQ ID NO: 9982 - protein, 529 aa, Guillardia theta
MSKIILYQEDARRALERGMDILAEAVSVTLGPKGRNVVLERKYGAPQIVNDGVTIAKEIELEDHIENTGVALIRQAASKTNDVAGDGTTTATVLAHAMVKQGMKNVAAGANAIALKRGIEKATQFIVTQIAEYARPVEDTRAISQVASISAGNDIETGKMIADAIDKVGREGVISLEEGKSTITELEMTEGMCFEKGFISPYFVTDTERMEVIQDNPYILLTDKKITLVQQELLPTLELISKTSRPLVIIAEDVEKEALATLVVNKLRGIVNVVAVRAPGFGDRRKAMLEDIAILTGGQVISEDAGFSLETLTLDMLGQARRITITKENTTIIAEGNEKDVKSRCEQIRRQIEASDSSYEREKLQERLAKLAGGVAVIKVGAATETEMKDKKLRLEDAINATKAAVEEGIVPGGGSTLTHLANDLKDWAEDNLIEDELIGALIVERSLTSPLRRIIENTGQNSAIIIEQIKESEFNIGYDAAKGEIVDMYDVGIIDPAKVTRSGLQNAASIASMILTTECIVVDKQDEK

SEQ ID NO: 9983 - protein, 222 aa, Brassica napus
  misc_feature (193)..(193): Xaa can be any naturally occurring amino acid
  misc_feature (213)..(213): Xaa can be any naturally occurring amino acid
MSLKALDYESLNENVKNCQYAVRGELYLRASELQKEGKKIIFTNVGNPHALGQKPLTFPRQVVALCQAPFLLDNPNVGMIFPADAIARAKHYLSLTSGGLGAYSDSRGLPGVRKEVAEFIQRRDGYPSDPELIFLTDGASKGVMQILNCIIRNQKDGILVPVPQYPLYSATISLLGGTLVPYYLEETDNWGLXDVNNLRQSVAQARSQGITVXMVIIKPRNP

SEQ ID NO: 9984 - protein, 720 aa, Xanthomonas campestris
MATRKFTQRSRIREGRPNPLGATWDGLGVNFALYSRNATRVELCLFDERGREQERIPLPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPENRGTFSALKTDELIDHISSLGVTAVELLPVHAFVDDQYLLEKGLRNYWGYNTLGFFAPQGRYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISANYGAEGETDNPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGNEMDEAAWHDPEARALMLRLDGRSPTTGLREIAANVTLLMLINAAPTSVAFTLPAMHDEHWRVLVDTARHGGRVVAGGSEWKAPAHSLTLLAVERDRIASSARIVSEGAR

SEQ ID NO: 9985 - protein, 721 aa, Chlamydophila abortus
MVERIVNSEDVSLLVSGRQSNPHKFLGIVSENSSQDRIILFRPGAHSVVVELQGNIAHAQHHHSGIFSLTAPKGTLPQDYRIYHQNGLLAHDPYAFPPLWGEVDSFLFHQGTHYKIYECMGAIPYNVQGISGVLFVVWAPHAQRVSVVGDFNFWNGLVNPLRKVSDLGVWELFIPGLEEGTLYKWEIVSASGEVLIKTDPYGKRFDVPPHAPSRVVDSDRYTWHDAAWMEKRKHRGDQPLAIYEVHVGSWQWHEGKPLGYRELAKKLAAYCKEMHYTHVELLPVTEHPLNESWGYQVTGYYAPTCRYGTPEDFQFFVDHLHRENIGVILDWVPGHFPTDGFALAHFDGEALYESIENHEPLHPHWRTYTFDYRCNEVVNFLLGSALFWLDKMHIDGLRVDAVTSMLYLDYGRQEGEWSPNIYGGRENLQAIEFIKHLNSVVHREFPGVLTFAEESTDFPKVTQAVAQGGLGFDYKWNLGWMHDTFRYIQVDPLFRSYHHKDLTFSLWYAFNERYLLPLSHDEVVHGKGSLLQKMPGDTWTKFAHMRLLLSYHICQPGKKLLFMGGEFAQGKEWTPDSPLDWHLLDHPDHAYLHKCVARMNALYCDLPYFWKGDGKQGSFRWVDFKDTENHVIAYYRFSGEDRSSALLCVHHFSSGYFPSYVLYCQDIHSCQLLFNSDDCCFGGSGKGNRQPVLCLDQHVSWGIDIELPPLATLIFHVDFVN

SEQ ID NO: 9986 - protein, 421 aa, Arabidopsis thaliana
MEKKGSVLMLRYEVGKFLGQGTFAKVYHARHLKTGDSVAIKVIDKERILKVGMTEQIKREISAMRLLRHPNIVELHEVMATKSKIYFVMEHVKGGELFNKVSTGKLREDVARKYFQQLVRAVDFCHSRGVCHRDLKPENLLLDEHGNLKISDFGLSALSDSRRQDGLLHTTCGTPAYVAPEVISRNGYDGFKADVWSCGVILFVLLAGYLPFRDSNLMELYKKIGKAEVKFPNWLAPGAKRLLKRILDPNPNTRVSTEKIMKSSWFRKGLQEEVKESVEEETEVDAEAEGNASAEKEKKRCINLNAFEIISLSTGFDLSGLFEKGEEKEEMRFTSNREASEITEKLVEIGKDLKMKVRKKEHEWRVKMSAEATVVEAEVFEIAPSYHMVVLKKSGGDTAEYKRVMKESIRPALIDFVLAWH

SEQ ID NO: 9987 - protein, 582 aa, Schizosaccharomyces pombe
MVSFLSSSVSRLPLRIAGRRIPGRFAVPQVRTYAKDLKFGVDARASLLTGVDTLARAVSVTLGPKGRNVLIDQPFGSPKITKDGVTVARSVSLKDKFENLGARLVQDVASKTNEVAGDGTTTATVLTRAIFSETVRNVAAGCNPMDLRRGIQLAVDNVVEFLQANKRDITTSEEISQVATISANGDTHIGELLAKAMERVGKEGVITVKEGRTISDELEVTEGMKFDRGYISPYFITDVKSQKVEFENPLILLSEKKVSAVQDILPSLELAAQQRRPLVIIAEDVDGEALAACILNKLRGQLQVVAIKAPGFGDNRRNMLGDLAVLTDSAVFNDEIDVSIEKAQPHHLGSCGSVTVTKEDTIIMKGAGDHVKVNDRCEQIRGVMADPNLTESEKEKLQERLAKLSGGIAVIKVGASSEVEVNEKKDRIVDALNAVKAAVSEGVLPGAGTSFVKASLRLGDIPTNNFDQKLGVEIVRKAITRPAQTILENAGLEGNLIVGKLKELYGKEFNIGYDIAKDRFVDLNEIGVLDPLKVVRTGLVDASGVASLMGTTECAIVDAPEESKAPAGPPGMGGMGGMPGMM

SEQ ID NO: 9988 - protein, 382 aa, Schizosaccharomyces pombe
MNDRGELFKPIKVGNMLLQHRIVHAPMTRLRATDYGKITGLMVEYYSQRSMIPGTLLIADATFVGEKSGGFPNNPRCFTKEQAESWIPLVEAVHKNKSFLFIQFWPLPGDLKDEYRNDLEKMQKITYSDCPQDPGGLPAGIHSFDAVQGVEVYKKKYMSKRDIQEHIQDFVNAADLAVNIAKADGVEIHQVNGFLLDRFVLGGFGDQCDPEYRGSIENRCRFPLEVLEAVTRKIGQERVGYRISPFSGWMQKIDFMEVNIYLMSEIAKRFPKLAYIHAIEPRKYWSGHKLVSSEQNTSFLQKYWKGPFITAGGYDPETAVQAANERGVLVAFGRNFIANPDLVFRIKHHIPLNKWDRSSFYLPKTEKGYTDYPFSKEFLQSK

SEQ ID NO: 9989 - protein, 243 aa, Triticum aestivum
  misc_feature (173)..(173): Xaa can be any naturally occurring amino acid
MVQSKKKFRGVRQRHWGSWVSEIRHPLLKRRVWLGTFETAEEAARAYDEAAILMSGRNAKTNFPVPRSANGEIIVAPAAARDGRGVGSSSSGAAGASSLSQILSAKLRKCCKTPSPSLTCLRLDTEKSHIGVWQKRAGARADSSWVMTVELNKEPATAAAAPTPKRQHGVGDXPSSSTSTSTTGSPPEALEDEERIALQMIQELLNRSTPASPVNGLVHGEKGTSSSEKIIARLESLSGYLPD

SEQ ID NO: 9990 - protein, 371 aa, Tripterygium regelii
ALSIAGAVQSQKLAVLAISQLQSLQGGDIKLLCDTVVESVRDLTGYDRVMVYKFHEDEHGEVVAESKRPDLEPYIGLHYPATDIPQASRFLFKQNRVRTIVDCHALPVRVIQDDGLMQPLCLVGSTLRAPHGCHAQYMENMGSMASLAMAVVINGNDEEVIGGRNTTRLWGLVVCHHTSARCIPFPLRYACEFLMQAFGLQLNMELQLAAQLMEKHVLKTRTLLCDMLLRDSPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPEDKDDGQRMHPRSSFKAFLEVVKSRSLP

SEQ ID NO: 9991 - protein, 102 aa, Oryza sativa
MSSDGGPVLGGLEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 9992 - protein, 574 aa, Caulobacter crescentus
MARPLLDDSIDLIASTGRQARPARLGMAVLVAGFLGFNVSAAIAIVWFAAAMVAEVYGLGVTRLSRRLNLSPVLRRLGYVTVVIVMVGVWTALTLVLWTSGNPALQWAAICLAAGQLIHAQSVTFRAPVLFAIDVGMPSTSLIVMPILTGGFAPVQIATMMTAVALMLLYTFTSATANNRRIAALEAAEAQALKASEAKSAFLAMISHEIRTPMNGVLAMTDALSRADLGPDQARQTALLKRSGEDLMTLLNDVLDISRIEAGKLEIECQPFDLPELLGDLRALWTPAATDKGLDLVLTIAPGLDAYRLGDPTRLRQILGNLVSNAVKFTRSGGVALSARPGEAPGAVVFDVADTGIGMTPEQQGRLFQSFSQADASIARRFGGSGLGLSICSQLATLMDGAITVDSDLGSGSTFRLTLPLPVTERPAAPAPAEPAADTAETPATPDSLAGLTVLVADDHPVNQAVARAILEAVGARVAVADNGEAALASLKSAPADLVLMDLHMPGLGGRETVRRIRRGEGGDPAVPIIALTGEALGEDPAAWRAEGFDAVQQKPVVARDLLAAAARLTARTA

SEQ ID NO: 9993 - protein, 360 aa, Wimmeria acuminata
AVQSQKLAVRAISQLQSLPGGDIKLLCDTVVESVRHLTGYDRVMVYKFHEDEHGEVVAERKRPDLEPYIGLHYPATDIPQASRFLFKQNRVRTIVDCHASPVRVIQDDGLMQPLCLVGSTLRAPHGCHAQYMENMGSIASLAMAVIINGNDEEVIGVRNATRLWGLVVCHHTSARCIPFPLRYACEFLMQAFGLQLNMDLQLAAQLSEKHVWKTRTLLCDMLLRDSPAGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVK

SEQ ID NO: 9994 - protein, 392 aa, Schizosaccharomyces pombe
MAVQKLYESQSKLFQPIKVGNMQLQHRMVHAPATRLRCLDNGLVMTDLVKEYYKQRSSIPGTLLITESLFSGAKSGGFSNIPCLYNDEHVEAWKPIVQAIHDNDCFVFIQFWNLPGELKVDYLEDQERLEKVTQGECPMDPTGLPAALGSAYSICGEELYVDKFMTKQDIQEHITTYTEAAKRAVFGCGADGVEVHQVNGFLLDKFVLNGYGDKCDPEYCGSLENRARFCLELLESVVNAIGQERVGYRISPFSDIWKDKDSFEAHVFMIKKIKERFPNLAYLHAIEPRQYWNGHVHITQEKNTLIYKNLWGDPFITAGGHDRDSAIQMAEQENTLVAFGRYFLSNPDLPFRLKYNLPLNKWDRATFYTKMSPKGYIDYPFSKEFLDTKKVE

SEQ ID NO: 9995 - protein, 151 aa, Clostridium acetobutylicum
MFGMVPFRRNNNGLMRREDFFDKMFDNFFSDDFFPTTTFNGNAGFKVDIKEDDDKYTVAADLPGVKKDNIELQYENNYLTINAKRDDIVETKDDNNNFVRRERSYGELRRSFYVDNIDDSKIDASFLDGVLRITLPKKVKGKDNGRRIDIH

SEQ ID NO: 9996 - protein, 374 aa, Wimmeria concolor
ALSIAGAVQSQKLAVRAISQLQSLPGGDIKLLCDTVVESVRHLTGYDRVMVYKFHEDEHGEVVAERKRPDLEPYIGLHYPATDIPQASRFLFKQNRVRTIVDCHASPVRVIQDDGLMQPLCLVGSTLRAPHGCHAQYMENMGSIASLAMAVIINGNDEEVIGVRNATRLWGLVVCHHTSARCIPFPLRYAWEFLMQAFGLQLNMELQLAAQLSEKHVWKTRTLLCDMLLRDSPTGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVKSRSLPWEN

SEQ ID NO: 9997 - protein, 374 aa, Zinowiewia concinna
ALSIAGAVQSQKLAVRAISQLQSLPGGDIKLLCDTVVETVRVLTGYDRVMVYKFHEDEHGEVVAESKRPDLEPYIGLHYPATDIPQASRFLFKQNRVRMIVDCHATPVSVIQDAGLMQPLCLVGSTLRAPHGCHAQYMENMGSIASLAMAVIINGNDEEGIGGRNTTRLWGLVVCHHTTARCIPFPLRYACEFLLQALGLQLNMELQLAAQLSEKHVLRTQTLLCDMLLRDSHTGIVTQSPSIMDLVKCDGAALYYQGKYYPLEVTPTEAQIKDIVEWVLAFHGDSTGLSTDSLADAGYPGAASLGDAVCGMAVAYITDRDFLFWFRSNTAKEIKWGGAKHHPEDKDDGQRMHPRSSFKAFLEVVKSRSLPWEN

SEQ ID NO: 9998 - protein, 259 aa, Brassica oleracea
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGLVLVYIRFQQHYYVQGEGSSVPKSNVACETNFVQDWFL

SEQ ID NO: 9999 - protein, 156 aa, Triticum aestivum
MATDPSKYKLNHSMIRIKDPKRSVQFYEFLGMKQINQIKNPDAKFDLYFLAYDSPKAVSHGNHWTDREGIVELTHNYGTEDDPNYKISNGNTEPHKGFGHLCISVDNLQAACQRLEDAGYKFQKKLTDGRMRHIAFVLDPDGYWVEVIGQKPLEET

SEQ ID NO: 10000 - protein, 749 aa, Aspergillus fumigatus
MATKIAGGLHRAQEVLQNTSSKSKKLVDLERDTADAHTQQPLTTDHGVRVSNTDQWLRVTNDRRTGPSLLEDQIAREKIHRFDHERIPERVVHARGTGAFGNFKLKESIEDLTYAGVLTDTSRNTPVFVRFSTVQGSRGSADTVRDVRGFAVKFYTDEGNWDIVGNNIPVFFIQDAVKFPDFVHAVKPEPHNEVPQAQTAHNNFWDFVYLHPEATHMFMWAMSDRAIPRSYRMMQGFGVNTFALVNKEGKRHFVKFHWIPHLGVHSLVWDEALKLGGQDPDFHRKDLMEAIDNKAYPKWDFAIQVIPEEKQDDFEFDILDATKIWPENLVPLRVIGELELNRNVDEFFPQTEQVAFCTSHIVPGIDFTDDPLLQGRNFSYFDTQISRLGINWEELPINRPVCPVLNHNRDGQMRHRITQGTVNYWPNRFEAVPPTGTKGSGVGGGFTTYPQRVEGIKNRALNDKFREHHNQAQLFYNSMSEHEKLHMKKAFSFELDHCDDPTVYERLAGHRLAEIDLELAQKVAEMVGAPIPAKALKQNHGRRAPHLSQTEFIPKNPTIASRRIAIIIGDGYDPVASTGLKTAIKAASALPFIIGTKRSAIYATEDKTSSKGIIPDHHYDGQRSTMFDATFIPGGPHVATLRQNGQIKYWISETFGHLKALGATGEAVDLVKETLSGTLHVQVASSQSPEPVEWYGVVTAGGKQKPESFKESVQILKGATDFVGKFFYQISQHRNYQRELDGLASTIAF

SEQ ID NO: 10001 - protein, 374 aa, Zinowiewia concinna
ALSIAGAVQSQKLAVRAISQLQSLPGGDIKLLCDTVVETVRVLTGYDRVMVYKFHEDEHGEVVAESKRPDLEPYIGLHYPATDIPQASRFLFKQNRVRMIVDCHATPVSVIQDAGLMQPLCLVGSTLRAPHGCHAQYMENMGSIASLAMAVIINGNDEEGIGGRNTTRLWGLVVCHHTTARCIPFPLRYACEFLLQALGLQLNMELQLAAQLSEKHVLRTQTLLCDMLLRDSHTGIVTQSPSIMDLVKCDGAALYYQGKYYPLEVTPTEAQIKDIVEWLLAFHGDSTGLSTDSLADAGYPGAASLGDAVCGMAVAYITDRDFLFWFRSNTAKEIKWGGAKHHPEDKDDGQRMHPRSSFKAFLEVVKSRSLPWEN

SEQ ID NO: 10002 - protein, 226 aa, Brassica napus
  misc_feature (18)..(18): Xaa can be any naturally occurring amino acid
  misc_feature (46)..(46): Xaa can be any naturally occurring amino acid
  misc_feature (70)..(70): Xaa can be any naturally occurring amino acid
  misc_feature (170)..(170): Xaa can be any naturally occurring amino acid
SILPKYKLGKTLCIGSFXAKVKIGEHLLTGHKVAIKILNRRKIKTXQIEDKVRREIKILRLFIHPHVIHXYEVIESPGDIYLVMESVKSAELFDYIVEKGRLQEDEGRNFFQQIISGVEYCHRNMVVRRDLKPENLLLNSMCNIKIADFWLSNVMRDGHFLKTSCGSPNXSCSQIISGKLYSGPEVDVLSCGVIFYALLCGTLPFDDENIPNLFKKIKVLYFDSAQ

SEQ ID NO: 10003 - protein, 331 aa, Kineococcus radiotolerans
MNLLPRSRGPSRLPEPPTMPATRTNRPRPPRRAPQKIPPTTGATHVPTHIPTTTLNNGVQMPVLGFGVFQVPAEEAERVVTDALAAGYRHLDTAAAYENEAGVGRAIAASGIPREELFVTTKLWIQDAGEQAAPAAFDRSLQRLGLDYLDLYLIHQPYGDYYGSWRAMEELNRTGRARAIGVSNFHPDRLVDLIDHTEVVPAVNQIETHPFFQRGTDHDVMRQRGVQHESWGPLGQGRDDLLTYPLLTELATAHGKTVAQVVLRWLLQRDTVVIPKSSRPQRMAENLDVFDFSLTEQEMTRIASLDTGVSAVFDHRDPASVAAFGTVRFDT

SEQ ID NO: 10004 - protein, 300 aa, Mannheimia succiniciproducens
MQWLKYKHRCKYSLGGNKMQTFKLNNGVEIPVLGFGVFQIPPEETEQAVISAIHAGYRHIDTAQAYMNETETGAGIRNSGVVREEIFVTSKVWIENYGYEAAKASLDRTLARLDIGYIDLMLLHQPFNDVYGAWRALEEYLAAGKIRAIGLSNFTADRVLDVGLYNKVMPAVNQIEINPFHQQQAQVEGLLSEGIVPEAWGPFAEGKFGIFENPVLAKIGQKYGKSIAQVVTRWLVQRGVVVLAKSTRPERMAENLNVFDFELDADDFAQIAALDVGKSQIISHTDLAMVRQFKEWVFNV

SEQ ID NO: 10005 - protein, 304 aa, Kineococcus radiotolerans
MSHTPSTSTPTPALTLNNGVTMPALGLGVFQSEPEETTDAVEAALATGYRHIDTAAGYGNEREVGEGVRRSGLERSEVFLETKVWVSDYGYEQTLHAFTKSAAKLGVEQIDLLILHQPMPQHFERTRAAYRALERLLTDGAVRAIGVSNFLPHHLTGLLEQAEVVPAVNQVELHPYFTQPDVQAANAAHGILTQAWSPIGGITFYPGWGENRTSALADPTIAAIAAAHGKTPAQVMLRWHLQQGRSAIPKSTKPTRIAENFAVHGFTLDDDELARLDSLDTGRRGGPDPDAVDPSTWDLTIPDA

SEQ ID NO: 10006 - protein, 349 aa, Schizosaccharomyces pombe
MAEFIRTQIFGTCFEITTRYSDLQPIGMGAFGLVCSAKDQLTGMNVAVKKIMKPFSTPVLAKRTYRELKLLKHLRHENIISLSDIFISPFEDIYFVTELLGTDLHRLLTSRPLETQFIQYFLYQILRGLKFVHSAGVIHRDLKPSNILINENCDLKICDFGLARIQDPQMTGYVSTRYYRAPEIMLTWQKYNVEVDIWSAGCIFAEMIEGKPLFPGRDHVNQFSIITELLGTPPMEVIETICSKNTLRFVQSLPQKEKVPFAEKFKNADPDAIDLLEKMLVFDPRKRISAADALAHNYLAPYHDPTDEPVADEVFDWSFQDNDLPVETWKVMMYSEVLSFHNMDNELQS

SEQ ID NO: 10007 - protein, 546 aa, Helicobacter pylori
MAKEIKFSDSARNLLFEGVRQLHDAVKVTMGPRGRNVLIQKSYGAPSITKDGVSVAKEIELSCPVANMGAQLVKEVASKTADAAGDGTTTATVLAYSIFKEGLRNITAGANPIEVKRGMDKAAEAIINELKKASKKVGGKEEITQVATISANSDHNIGKLIADAMEKVGKDGVITVEEAKGIEDELDVVEGMQFDRGYLSPYFVTNAEKMTAQLDNAYILLTDKKISSMKDILPLLEKTMKEGKPLLIIAEDIEGEALTTLVVNKLRGVLNIAAVKAPGFGDRRKEMLKDIAILTGGQVISEELGLSLENAEVEFLGKAGRIVIDKDNTTIVDGKGHSDDVKDRVAQIKTQIASTTSDYDKEKLQERLAKLSGGVAVIKVGAASEVEMKEKKDRVDDALSATKAAVEEGIVIGGGAALIRAAQKVHLNLHDDEKVGYEIIMRAIKAPLAQIAINAGYDGGVVVNEVEKHEGHFGFNASNGKYVDMFKEGIIDPLKVERIALQNAVSVSSLLLTTEATVHEIKEEKAAPAMPDMGGMGGMGGMGGMM

SEQ ID NO: 10008 - protein, 140 aa, Glycine max
MVSFEMNDRKKIGLGLTGFGIFFSFLGIIFFFDKGLLAMGNVLFVSGVSITIGLKSTMQFFMKRSNFKGTISFGVGFFILIMGWPIVGMIVEAYGFVVLFSGFWPTLAVFLQKIPVLGWLFQQPFIRSLFDRYRGKRMPV

SEQ ID NO: 10009 - protein, 95 aa, Brassica rapa
GTSRDVDPNANDLQVESLARFAVDEHNKKENVSLEYRRLIGAKTQVVAGTMHHLTVEVADGETKKVYEAKVLEKAWENLKKLEDFTHLRMFSFIT

SEQ ID NO: 10010 - protein, 493 aa, Glycine max
VIESRFPLAHRRKKGLGSRNRDSGKEFSIGVVPRISSICYPQCGYFPSSGGFTAKRRKCNSLLRLKDCSENIRQHASILFVRLVTGVMLVMAVSLASSEPSWALSEENLLFLEAWRTIDRAYIDKSFNGQSWFRYREDALRNEPMNNRDETYTAIRKMLATLDDPFTRFLEPEKFRSLRSGTKGALTGVGLSIGYPTKADMQPGGLVVISASPGGPAYRAGVSSGDVILAIDDTNTENMGLYDAAERLQGPEGSSIALTIRSGSDIKHLDLTREKVSLNPVKSRLCKLPASGNDSPTIGYIKLTSFNQKASSAIKEAINTLRSDNVNAFVLDLRDNSGGLFPEGIEIAKIWLDKGVIVYICDSRGVRDILDTDGSSALATSEPLVVLVNKGTASASEILAGALKDNKRAVLFGEPTFGKGKIQSVFELSDGSGLVVTVARYETPAHTDIDKVGVIPDHPLPISFPKDEDAFCNCLQDPASSCYVNRIQLFSKS

SEQ ID NO: 10011 - protein, 460 aa, Mycobacterium bovis
MSRSHPSVPAHSIAPAYTGRMFTAPVPALRMPDESMDPEAAYRFIHDELMLDGSSRLNLATFVTTWMDPEAEKLMAETFDKNMIDKDEYPATAAIEARCVSMVADLFHAEGLRDHDPTSATGVSTIGSSEAVMLGGLALKWRWRQRVGSWKGRMPNLVMGSNVQVVWEKFCRYFDVEPRYLPMERGRYVITPEQVLAAVDENTIGVVAILGTTYTGELEPIAEICAALDKLAAGGGVDVPVHVDAASGGFVVPFLHPDLVWDFRLPRVVSINVSGHKYGLTYPGVGFVVWRGPEHLPEDLVFRVNYLGGDMPTFTLNFSRPGNQVVGQYYNFLRLGRDGYTKVMQALSHTARWLGDQLREVDHCEVISDGSAIPVVSFRLAGDRGYTEFDVSHELRTFGWQVPAYTMPDNATDVAVLRIVVREGLSADLARALHDDAVTALAALDKVKPGGHFDAQHFAH

SEQ ID NO: 10012 - protein, 255 aa, Xanthomonas campestris
MRLTALPAFDDNYIWALVANDGRAVIVDPGQAAPVLEAAQREGFTPVAALLTHHHADHIGGVAELQQHFPALELYGPDDERMPSATRHVAHGDTVTALGIDFAVLEVPGHTRSHVAYVGDGHLFSGDTLFSLGCGRMFEGTPPQMFDALQRLASLPGETLVCCGHEYTLANAAFALHVDPTNAALQRRQQEAQAMRHAARPTLPISLKSELATNPFLRLHTPEIRAAAAAHASISITSDVDVFAELRRWKDAFRA

SEQ ID NO: 10013 - protein, 122 aa, Triticum aestivum
  misc_feature (16)..(16): Xaa can be any naturally occurring amino acid
  misc_feature (67)..(67): Xaa can be any naturally occurring amino acid
ERTSGGYFELVGFDPXEVQQEIYKFVSIGLCAPVVAQCLVELMVNPPREGSPSYELYRQEYDGIFNXLKTRAFALYEAFKEMEGVECDEPQGSMYLFPTIKLSSKAVEAAKKEGRSPDEYYA

SEQ ID NO: 10014 - protein, 770 aa, Unknown
  Synechocystis sp. PCC 6803
MTYTINADQVHQIVHNLHHDPFEVLGCHPLGDHGKVNQWVIRAYLPTAEAVTVLLPTDRREVIMTTVHHPNFFECVLELEEPKNYQLRITENGHERVIYDPYGFKTPKLTDFDLHVFGEGNHHRIYEKLGAHLMTVDGVKGVYFAVWAPNARNVSILGDFNNWDGRLHQMRKRNNMVWELFIPELGVGTSYKYEIKNWEGHIYEKTDPYGFYQEVRPKTASIVADLDGYQWHDEDWLEARRTSDPLSKPVSVYELHLGSWLHTAYDEPVKTLHGEGVPVEVSEWNTGARFLTYYELVDKLIPYVKELGYTHIELLPIAEHPFDGSWGYQVTGYYAPTSRFGSPEDFMYFVDQCHLNGIGVIIDWVPGHFPKDGHGLAFFDGTHLYEHGDPRKGEHKEWGTLIFNYGRNEVRNFLVANALFWFDKYHIDGMRVDAVASMLYLDYCREEGEWVANEYGGRENLEAADFLRQVNSVVYSYFPGILSIAEESTSWPMVSWPTYVGGLGFNLKWNMGWMHDMLDYFSMDPWFRQFHQNSITFSMWYNHSENYMLALSHDEVVHGKSNMLGKMPGDEWQKYANVRALFTYMFTHPGKKTMFMSMEFGQWSEWNVWGDLEWHLLNFPPHQQLKQFFTELNHLYKNEPALYSNDFDESGFQWIDCSDNRHSVVSFIRRAKNSAEFVVTICNFTPQPHSHYRVGVPVPGFYTELFNSDARQYGGSNMGNLGGKWTEEWSFHEQPYSLDLCLPPLSVLVLKLSQNAEENTVPAEEASNIA

SEQ ID NO: 10015 - protein, 419 aa, Thermobifida fusca
MSTTVVLFTRDLRVSDHPALHAAVTEADRVVPLFVVDPALVRVSARNRIAYLLEALAELRGLLRERGGELVVRQGDTVAETVRIVAEAGAQAVYLSADVSAAAVRRARQLTEAVRAAGAHVRTFPGVTVVPPGALRPAHGDHYQIFTPYLNAWRAAQWRSPRPAPERVRLPEGLVPGPLPGAELIRLGTGVLAPQREQGGPRTARERIRAWLAQPNQDSRFGCHLHFGCLSPLEVALVAREHPRGALLLRQLALRDFHHQVLQAFPRLPRADYRPRPIQWRDDDSAFAAWCSGRTGVPIVDAGMRQLLWEGYVPGRIRMLTATYLTQVLRIHWKRGADHFYSLLVDGDVANNYGNWQQIAGTGGVPRPARRINLYRQAERYDPSGDYVRRFVPELRSISGSAVHHPPVPRPGGYPPPLR

SEQ ID NO: 10016 - protein, 404 aa, Vibrio fischeri
MQNIGMSSKLSSVCYDIRGPVLKHAKRMEEEGHKILKLNIGNPAPFGFDAPDEILVDVIKNLPTSQGYCDSKGIYSARKAVVQHYQRRGLLDLDVEDVYIGNGASELIVMAMQALLNNGDEMLVPAPDYPLWTAAVSLSGGKPVHYMCDEGADWYPDLDDIKKKITPNTKGIVLINPNNPTGAVYSRDFLLQVVEIARQNNLIIFADEIYDKVLYDGAVHTTLATLAPDILTVTFNGLSKAYRVCGFRGGWMFLNGPKDHAQGYIAGLDMLASMRLCANVPMQHAIQTALGGYQSINELLLPGGRLLEQRDKAYDLITQIPGVSCVKPKGAMYLFPKLDPKMYKIKDDQKFVLDFLIKEKVLLVQGTGFNWPTPDHFRIVTLPRVDDLETAIGRLERFLHTYKQ

SEQ ID NO: 10017 - protein, 483 aa, Oryza sativa
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 10018 - protein, 169 aa, Brassica napus
  misc_feature (166)..(166): Xaa can be any naturally occurring amino acid
MGGTKEDGSGFSRKAMRKEKRAFFFRKWTSVDVMRASSVMAVHLSCVLAPFNYKWEALLFGFLLAAVTNLSITFSYHRNLTHKSFKLPKWLEYPFAYSALFALQGHPIDWVSTHRFHHQFTDSDRDPHSPIEGFWFSHVLWIFDTSYLREKCGARNNVMDLKQQWXYRF

SEQ ID NO: 10019 - protein, 166 aa, Rhodopseudomonas palustris
MNMRDIIPWGRTNQPATRSFEGDPFLSLHREMNRLFDDVFRGFDLPARAGTLAPFSTGWPKLEITDGDKELKIAAAVPGLEEKDIEVLLDDGTLTIRGEKTSSTEAKDKQFSEHFYGKFERRIPLDVAVAADQVSASFKNGVLTVTLPKAEPSPSTAKRIEIQKTN

SEQ ID NO: 10020 - protein, 1355 aa, Oryza sativa
MGSEAAAARPVVVTVNGERYEAVGVDPSTTLLEFLRTRTPVRGPKLGCGEGGCGACVVVVSKYDAVADEVTEFSASSCLTLLGSLHHCAVTTSEGIGNSRDGFHAVQRRLSGFHASQCGFCTPGMCMSIYSALAKADRCSSRPSPPPGFSKLTAAEAEKAVSGNLCRCTGYRPIVDACKSFAADVDLEDLGLNAFWKKGADDERADVGKLPAYSGGAAVCTFPEFLKSEIRSSMGQANGGAPAVAVTGDGWFHPKSVEEFHRLFDSNLFDERSVKIVASNTGSGVYKDQDLHDKYINISQILELSAINRSSKGVEIGAVVSISKAIEILSDGGAVFRKIADHLSKVASSFVQNTAAIGGNIIMAQRLSFPSDIATVLLAAGSTVTIQVAAKRMCITLEEFLKQPPCDSRTLLVSISIPDWGSDDGITFESFRAAPRPLGNAVSYVNSAFLARSSVDGSSGSHLIEDVCLAFGAFGAEHAIRAREVEEFLKGKLVSAPVILEAVRLLKGVVSPAEGTTHPEYRVSLAVSYLFRFLTSLANGLDEPENANVPNGSCTNGTANGSANSSPEKHSNVDSSDLPIKSRQEMVFSDEYKPVGKPIEKTGAELQASGEAVYVDDIPAPKDCLYGAFIYSTHPHAHIKDINFRSSLASQKVITVITAKDIPTGGENIGSCFPMLGDEALFVHPVSEFAGQNIGVVIAETQKYAYMAAKQAVIEYSTENLQPPILTIEDAVQHNSYFPVPPFLAPTPIGDFNQAMSEADHKIIDGEVKLESQYYFYMETQTALAIPDEDNCITLYVSAQLPEITQNTVARCLGIPYHNVRIITRRVGGGFGGKAMKAIHVAAACAVAAFKLRRPVRMYLDRKTDMIMAGGRHPMKVKYSVGFKSDGKITGLHFDLGMNGGISPDCSPVLPVAIVGALKKYNWGALSFDIKVCKTNVSSKSAMRAPGDAQGSFIAEAIVEHIASTLSVDTNAIRRKNLHDFESLKVFYGNSAGDPSTYSLVTIFDKLASSPEYQQRAAMVEHFNAGNRWKKRGISCVPITYDVRLRPTPGKVSIMNDGSIAVEVGGVEIGQGLWTKVKQMTAFALGQLCDDGGEGLIDKVRVIQADTLSMIQGGFTGGSTTSETSCEAVRKSCAALVERLKPIKEKAGTPPWKSLIAQASMASVKLTEHAYWTPDPTFTSYLNYGAAISEVEVDVLTGETTILRSDLVYDCGQSLNPAVDLGQVEGAFVQGIGFFTNEEYTTNSDGLVINDGTWTYKIPTVDTIPKQFNVELINSARDHKRVLSSKASGEPPLLLASSVHCAMREAIRAARKEFAGAGGSPLTFQMDVPATMPIVKELCGLDVVERYLESFAAKA

SEQ ID NO: 10021 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 10022 - protein, 546 aa, Bdellovibrio bacteriovorus
MSKVITFSEDARTHILKGVNTLANAVKVTLGPKGRNVVIDKSFGSPLITKDGVTVAKEIELENKFENMGAQMVKEVASKTNDEAGDGTTTATVLAQAIYREGAKLVSAGHNPMSIKRGIDKAVGIIIEELKSMSKPVKGSNEVAQVGAISANNDKEIGQMLADAMDKVGREGVITIEESKTAKTEVTVVEGMQFDRGYLSPYFVTNAERMEAVLENAYVLVYDKKISSMKDMIGILEGVAKQGRQLLIIAEDVEGEALATLVVNKLRGTLHIAAVKAPGFGDRRKAMLEDIAILTGAKVISEDVGLKLEAATVADLGVAKRIVVDKDNTTIIDGAGKKNDINGRVGQIKAQIEETSSDYDKEKLKERLAKLAGGVAVIHVGAPSEVEMKEKKHRVEDALNATRAAVEEGIVAGGGTALLRASTKIDKSKFSEEEQFGATIIKRACEEPIRQIAANAGLDGAIVLDRILQNKSTTWGFNAYSDEYTDLIKDGVIDPVKVVRCALTNAASVSSLMLTTETMIAEAPKKESAAPAMPGHDGMGGMGGMM

SEQ ID NO: 10023 - protein, 523 aa, Lycopersicon esculentum
MFKTNNVTARLFERQICTPAPGTSIHRARRFYENVVPSYTIYDVECPDHSFRKFTDDGLYFVSFSRNHQDLVVYRPTWLTFSCKEEDCDTHDLPLKARKFESFFTQLYSVTLASSGELICKDFFLYMESNQFGLFATSTAQIHDAPPTGGAIQGVPSVEKITFHLLRLVDGAILDERVFHNDYVNLAHSIGAFLYDDLLAIVSLRYQRIHILQIRDSGDLVDVRAIGEFCREDDELFLNSNSQVLVNHVGNGFHHSLPQSETSFLSGIKQRLLSYIFRGIWNEADQTMRVQCLKKKFYFHFQDYIDLIIWKVQFLDRHHLLIKFGSVDGGVSRNADIHPSFFAVYNMETTEIVAFYQNSADELYFLFELFSDHFHVSSKSSLHMNFMSSHSNNIHALEQLRCTKNKATNFSQFVKKMMASLPCSCQSQSPSPYFDQSLFRFDEKLISAIDRHRQSTDHPIKFISRRQPNILKFKMKPGPEAGSTDGRTKKICSFLFHPILPLALSVQQTLFLQASVVNIHFRR

SEQ ID NO: 10024 - DNA, 9215 bp, Unknown
  Artificial
  base vector pMON65154
actcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctgagtactggcgcgcctgcggccgcctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccattagcaaggcccagcccaacccaacccaacccaacccaccccagtccagccaactggacaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatctgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaccgcgggatatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacccaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatggggatcccccaccctgcaatgtgaccctagacttgtccatcttcggatggccaacttaattaatgtataaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaagaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatatcgcgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgaccgctgatcgatcgcggccgctggcgcgccagtactagctagtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagt

SEQ ID NO: 10025 - DNA, 9747 bp, Unknown
  Artificial
  base vector pMON72472
ccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaagaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatatcgcgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgaccgctgatcgatcgcggccgctggcgcgccctcgagaggcctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactacggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaacatgactctcttaaggtagccaaagccccggaattcggcgcgcctgcggccgcctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaccgcgggatatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatggggatcccccaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagcttt

SEQ ID NO: 10026 - DNA, 10289 bp, Unknown
  Artificial
  base vector pMON82060
cgcgccttaattaagcggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgcctgcggccgcctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaccgcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaagaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatatcgcgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgaccgctgatcgatcgcggccgctgg

SEQ ID NO: 10027 - DNA, 9754 bp, Unknown
  Artificial
  base vector pMON74532
gatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgcaggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgccaggcctggtagtctgattaattaagcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagctt

SEQ ID NO: 10028 - DNA, 9769 bp, Unknown
  Artificial
  base vector pMON82053
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 10029 - DNA, 10846 bp, Unknown
  Artificial
  pMON74470
actagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatccccgggcggccgcgttatcaagctaactgcaggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctaccatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattgaccgctcgagcgattacaaggatgatgatgataagtaagtcgacctagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacggatccccgggcggccgccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcatcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgtggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagctt

SEQ ID NO: 10030 - DNA, 3849 bp, Unknown
  Artificial
  pMON74916
accatgtcttcctcgaggcctgcccactcttcaagttcatccagcaggactcgccagagctcccgggcaaggatattagcacaaacaacccttgatgctgaactcaatgcagagtacgaagaatctggtgattcctttgattactccaagttggttgaagcacagcggagcactccacctgagcagcaagggcgatcgggaaaggtcatagcctacttgcagcatattcaaagaggaaagcttatccaaccatttggttgcctgttggcccttgacgagaagagcttcagggtcattgcattcagtgagaatgcacctgaaatgcttacaacggtcagccatgctgtgccaaacgttgatgatcccccgaagctaggaattggtaccaatgtgcgctcccttttcactgaccctggtgctacagcactgcagaaggcacttggatttgctgatgtttctttgctgaatcctatcctggttcagtgcaagacctcaggcaagccattctatgccattgttcacagggcaactggttgtctggtggtagattttgagcctgtgaagcctacagaatttcctgccactgctgctggggctttgcagtcctacaagcttgctgccaaggcaatctccaagatccagtcactactaggtggaagcatggaggccttatgcaataccgtggttaaggaagtctttgacctgacaggttatgacagggttatggcttacaagttccatgaagatgagcatggggaggtctttgctgagatcaccaaacctggtattgagccctatataggcctgcactatccagccactgatatccctcaagctgccaggtttctcttcatgaagaacaaagtcagaatgatctgtgattgccgtgcaagatccgtgaagattattgaagatgaggcactctccattgatattagcttgtgtggttcaactcttagagcaccacatagctgtcaccttaagtatatggagaacatgaactcgattgcatctcttgtcatggctgttgtggtcaatgaaaatgaagaggatgatgaacccgagcctgaacaaccaccacaacagcagaagaagaagaggctgtggggtctcattgtttgccaccatgagagccccagatatgtcccgttcccactgcggtatgcctgtgaattcttggcccaagtgtttgctgtccatgtaaacaaggagtttgaattggagaagcagatacgagagaaaaacattctgcgaatgcaaacaatgctctctgacatgctgttcaaggaatcatctcccttgagtatcgtgtctgggagtccaaatatcatggacctagttaagtgtgatggcgctgctcttttgtatggggacaaagtatggcggcttcaaacggctccaaccgagtctcagattcgtgatattgccttctggctttcagaagttcatggggattccactggcttgagtactgatagcctccaggatgctggatatccaggagctgcttcccttggtgacatgatttgtggaatggcagtggccaagatcacgtccaaggacattcttttctggttcaggtcacatacagctgctgaaatcaaatggggaggtgcaaagcatgatccatctgataaggatgacaacagaaggatgcaccctaggttatcctttaaggctttccttgaggttgtcaagacgaagagtttgccatggagtgactacgagatggatgctattcactcattgcagcttattcttagaggtacactgaatgatgcctcgaagccagcccaggcatctggtttagataaccagatcggtgatctaaaacttgatgggcttgctgaattgcaagcagtgacaagtgaaatggtccgcctgatggaaacagcaactgttccgatcttggcagtagatggcaatggattggtcaatggatggaaccaaaaggtagcggagttgtcaggtctgagagttgatgaggctataggaagacacatacttacacttgtggaggattcttctgtatcacttgttcagaggatgctatatttagctctgcaaggtgagtggaactaaaaggttttaagcacctttactgtctgcaccatttaattactattcttactgttaatagtcaaccctcagaaaaaatgaataaatttattgtattacgtattggtttctgaatatttcatcaattgagcaggcagagaagagaaggaagttcgatttgagctgaaaacacatggctccaagagggatgatggccctgttatcttggtcgtaaatgcttgtgccagtcgtgatcttcatgaccatgttgttggggtgtgctttgtagcccaggacatgactgttcacaagttggtcatggacaaatttactcgggtcgagggggactacaaggcaatcatccacaacccgaacccactcattcctcctatatttggtgctgaccagtttggatggtgctctgagtggaatgcagccatgaccaagcttaccgggtggcacagagatgaagtggttgataagatgctccttggcgaggtttttaacagcagcaatgcttcctgccttctgaagagcaaagatgcctttgtacgtctttgcattgtcatcaacagtgcattagctggtgaagaggcagaaaaggcttcattcggcttctttgaccgcaatgagaaatatgtcgaatgccttctgtcggtgaacaggaaagtaaatgcagatggtgttgtcactggagtgttctgtttcatccatgttcctagtgatgacctgcagcatgcgctacatgtgcagcaagcctctgagcagacagcacaaagaaagttgaaggctttctcgtacatgcgacatgccatcaacaaacctctctcaggtatgctttattctagggaaacactcaagagcacaggtctgaatgaagagcagatgaggcaggttcgcgtcggagacaattgccatcgccagctaaacaagatacttgccgacttggatcaagataacatcactgacaagtaaccttcttgccaagtcttttaaactgttctattaggttcttgtatttatttccgtcttcctcgtaatttgacaattttctgaacagtaggttgatggtatcacttaattttacttcactagctacgaagcttatagccatattcgttacaaccaacttaatatttctgtatcattatgttcacaggtcaagctgcttggatttggatatggctgaatttgtgttgcaagatgtggtggtgtctgctgtaagtcaagtgctgataggttgccaggctaaaggtatcagagttgcttgcaacctgccagagagatccatgaagcaaggggtttacggggatggtatccgactccagcagatcgtctccgacttcctatttgtttcggtgaagttctctcctgctggtggctctgttgacatctcttccaagctgactaagaacagcattggggaaaaccttcacctcatagacttcgaacttaggtatgctgggcatgctagtttgcaagcatacattcatttctgaactggaaagcatgaggtgtgaaggcttaagttactcttgtgtttatggctttatgattttcaggatcaagcaccgaggagcaggagtcccagcggaaatattgtcgcaaatgtatgaggaggacaataaagagcagtcagaggagggcttcagccttgctgtttctagaaaccttctgaggctcatgaatggtgacatccgtcacctcagggaagctggcatgtcaaccttcattctcactgctgaacttgctgctgctccttcagcagttggacgatgatgaatcgatgac

SEQ ID NO: 10031 - protein, 1530 aa, Artificial
  consensus for SEQ ID NO: 136 and its homologs
  Misc_feature (1)..(1): location 1 can be absent or Met
  Misc_feature (2)..(2): location 2 can be absent or Pro
  Misc_feature (3)..(3): location 3 can be absent or Gly
  Misc_feature (4)..(4): location 4 can be absent or Asn
  Misc_feature (5)..(5): location 5 can be absent or Glu
  Misc_feature (6)..(6): location 6 can be absent or Tyr
  Misc_feature (7)..(7): location 7 can be absent or Gly
  Misc_feature (8)..(8): location 8 can be absent or Glu
  Misc_feature (9)..(9): location 9 can be absent or Arg
  Misc_feature (10)..(10): location 10 can be absent or Ile
  Misc_feature (11)..(11): location 11 can be absent or His
  Misc_feature (12)..(12): location 12 can be absent or Asn
  Misc_feature (13)..(13): location 13 can be absent or Phe
  Misc_feature (14)..(14): location 14 can be absent or Phe
  Misc_feature (15)..(15): location 15 can be absent or Gly
  Misc_feature (16)..(16): location 16 can be absent or Gln
  Misc_feature (17)..(17): location 17 can be absent or Glu
  Misc_feature (18)..(18): location 18 can be absent or Gly
  Misc_feature (19)..(19): location 19 can be absent or Leu
  Misc_feature (20)..(20): location 20 can be absent or Ser
  Misc_feature (21)..(21): location 21 can be absent or Gln
  Misc_feature (22)..(22): location 22 can be absent or Asp
  Misc_feature (23)..(23): location 23 can be absent or Ser
  Misc_feature (24)..(24): location 24 can be absent or His
  Misc_feature (25)..(25): location 25 can be absent or Gln
  Misc_feature (26)..(26): location 26 can be absent or Pro
  Misc_feature (27)..(27): location 27 can be absent or Gln
  Misc_feature (28)..(28): location 28 can be absent or Ala
  Misc_feature (29)..(29): location 29 can be absent or Gly
  Misc_feature (30)..(30): location 30 can be absent or Asp
  Misc_feature (31)..(31): location 31 can be absent or Gly
  Misc_feature (32)..(32): location 32 can be absent or Ser
  Misc_feature (33)..(33): location 33 can be absent or Trp
  Misc_feature (34)..(34): location 34 can be absent or Ser
  Misc_feature (35)..(35): location 35 can be absent or Gly
  Misc_feature (36)..(36): location 36 can be absent or Phe
  Misc_feature (37)..(37): location 37 can be absent or Arg
  Misc_feature (38)..(38): location 38 can be absent or Asn
  Misc_feature (39)..(39): location 39 can be absent or Gly
  Misc_feature (40)..(40): location 40 can be absent or Leu
  Misc_feature (41)..(41): location 41 can be absent or Val
  Misc_feature (42)..(42): location 42 can be absent or Ser
  Misc_feature (43)..(43): location 43 can be absent or Asn
  Misc_feature (44)..(44): location 44 can be absent or Gln
  Misc_feature (45)..(45): location 45 can be absent or Arg
  Misc_feature (46)..(46): location 46 can be absent or Gln
  Misc_feature (47)..(47): location 47 can be absent or Ile
  Misc_feature (48)..(48): location 48 can be absent or Asp
  Misc_feature (49)..(49): location 49 can be absent or Pro
  Misc_feature (50)..(50): location 50 can be absent or Ser
  Misc_feature (51)..(51): location 51 can be absent or Leu
  Misc_feature (52)..(52): location 52 can be absent or Ile
  Misc_feature (53)..(53): location 53 can be absent or Ala
  Misc_feature (54)..(54): location 54 can be absent or Asn
  Misc_feature (55)..(55): location 55 can be absent or Leu
  Misc_feature (56)..(56): location 56 can be absent or Lys
  Misc_feature (57)..(57): location 57 can be absent or Thr
  Misc_feature (58)..(58): location 58 can be absent or Tyr
  Misc_feature (59)..(59): location 59 can be absent or Ser
  Misc_feature (60)..(60): location 60 can be absent or Thr
  Misc_feature (61)..(61): location 61 can be absent or Gln
  Misc_feature (62)..(62): location 62 can be absent or Gln
  Misc_feature (63)..(63): location 63 can be absent or Ser
  Misc_feature (64)..(64): location 64 can be absent or Val
  Misc_feature (65)..(65): location 65 can be absent or Asp
  Misc_feature (66)..(66): location 66 can be absent or Pro
  Misc_feature (67)..(67): location 67 can be absent or Glu
  Misc_feature (68)..(68): location 68 can be absent or Arg
  Misc_feature (69)..(69): location 69 can be absent or Gly
  Misc_feature (70)..(70): location 70 can be absent or Gln
  Misc_feature (71)..(71): location 71 can be absent or Ser
  Misc_feature (72)..(72): location 72 can be absent or Ser
  Misc_feature (73)..(73): location 73 can be absent or Asn
  Misc_feature (74)..(74): location 74 can be absent or Ser
  Misc_feature (75)..(75): location 75 can be absent or Gln
  Misc_feature (76)..(76): location 76 can be absent or His
  Misc_feature (77)..(77): location 77 can be absent or Gly
  Misc_feature (78)..(78): location 78 can be absent or Leu
  Misc_feature (79)..(79): location 79 can be absent or Asn
  Misc_feature (80)..(80): location 80 can be absent or Phe
  Misc_feature (81)..(81): location 81 can be absent or Ala
  Misc_feature (82)..(82): location 82 can be absent or Gln
  Misc_feature (83)..(83): location 83 can be absent or Gln
  Misc_feature (84)..(84): location 84 can be absent or Pro
  Misc_feature (85)..(85): location 85 can be absent or Met
  Misc_feature (86)..(86): location 86 can be absent or Arg
  Misc_feature (87)..(87): location 87 can be absent or Ser
  Misc_feature (88)..(88): location 88 can be absent or Asp
  Misc_feature (89)..(89): location 89 can be absent or Tyr
  Misc_feature (90)..(90): location 90 can be absent or Ser
  Misc_feature (91)..(91): location 91 can be absent or Arg
  Misc_feature (92)..(92): location 92 can be absent or Ser
  Misc_feature (93)..(93): location 93 can be absent or Val
  Misc_feature (94)..(94): location 94 can be absent or Leu
  Misc_feature (95)..(95): location 95 can be absent or Arg
  Misc_feature (96)..(96): location 96 can be absent or Glu
  Misc_feature (97)..(97): location 97 can be absent or His
  Misc_feature (98)..(98): location 98 can be absent or Gln
  Misc_feature (99)..(99): location 99 can be absent or Gln
  Misc_feature (100)..(100): location 100 can be absent or Ser
  Misc_feature (101)..(101): location 101 can be absent or Thr
  Misc_feature (102)..(102): location 102 can be absent or Thr
  Misc_feature (103)..(103): location 103 can be absent or Gly
  Misc_feature (104)..(104): location 104 can be absent or Tyr
  Misc_feature (105)..(105): location 105 can be absent or Met
  Misc_feature (106)..(106): location 106 can be absent or His
  Misc_feature (107)..(107): location 107 can be absent or Gly
  Misc_feature (108)..(108): location 108 can be absent or Asn
  Misc_feature (109)..(109): location 109 can be absent or Leu
  Misc_feature (110)..(110): location 110 can be absent or Met
  Misc_feature (111)..(111): location 111 can be absent or Leu
  Misc_feature (112)..(112): location 112 can be absent or Gln
  Misc_feature (113)..(113): location 113 can be absent or Ala
  Misc_feature (114)..(114): location 114 can be absent or Ser
  Misc_feature (115)..(115): location 115 can be absent or Pro
  Misc_feature (116)..(116): location 116 can be absent or Asn
  Misc_feature (117)..(117): location 117 can be absent or Glu
  Misc_feature (118)..(118): location 118 can be absent or Gly
  Misc_feature (119)..(119): location 119 can be absent or Ser
  Misc_feature (120)..(120): location 120 can be absent or Phe
  Misc_feature (121)..(121): location 121 can be absent or Val
  Misc_feature (122)..(122): location 122 can be absent or Gly
  Misc_feature (123)..(123): location 123 can be absent or Val
  Misc_feature (124)..(124): location 124 can be absent or Asp
  Misc_feature (125)..(125): location 125 can be absent or Val
  Misc_feature (126)..(126): location 126 can be absent or Glu
  Misc_feature (127)..(127): location 127 can be absent or Ser
  Misc_feature (128)..(128): location 128 can be absent or Ser
  Misc_feature (129)..(129): location 129 can be absent or Arg
  Misc_feature (130)..(130): location 130 can be absent or Asp
  Misc_feature (131)..(131): location 131 can be absent or Arg
  Misc_feature (132)..(132): location 132 can be absent or Leu
  Misc_feature (133)..(133): location 133 can be absent or Ser
  Misc_feature (134)..(134): location 134 can be absent or Gly
  Misc_feature (135)..(135): location 135 can be absent or Ser
  Misc_feature (136)..(136): location 136 can be absent or Gly
  Misc_feature (137)..(137): location 137 can be absent or Phe
  Misc_feature (138)..(138): location 138 can be absent or Thr
  Misc_feature (139)..(139): location 139 can be absent or Leu
  Misc_feature (140)..(140): location 140 can be absent or Asp
  Misc_feature (141)..(141): location 141 can be absent or Arg
  Misc_feature (142)..(142): location 142 can be absent or His
  Misc_feature (143)..(143): location 143 can be absent or Lys
  Misc_feature (144)..(144): location 144 can be absent or Thr
  Misc_feature (145)..(145): location 145 can be absent or Pro
  Misc_feature (146)..(146): location 146 can be absent or Met
  Misc_feature (147)..(147): location 147 can be absent or Arg
  Misc_feature (148)..(148): location 148 can be absent or Phe
  Misc_feature (149)..(149): location 149 can be absent or Asp
  Misc_feature (150)..(150): location 150 can be absent or Met
  Misc_feature (151)..(151): location 151 can be absent or Gly
  Misc_feature (152)..(152): location 152 can be absent or Glu
  Misc_feature (153)..(153): location 153 can be absent or Ser
  Misc_feature (154)..(154): location 154 can be absent or Pro
  Misc_feature (155)..(155): location 155 can be absent or Val
  Misc_feature (156)..(156): location 156 can be absent or Asn
  Misc_feature (157)..(157): location 157 can be absent or Tyr
  Misc_feature (158)..(158): location 158 can be absent or Asp
  Misc_feature (159)..(159): location 159 can be absent or Phe
  Misc_feature (160)..(160): location 160 can be absent or Phe
  Misc_feature (161)..(161): location 161 can be absent or Gly
  Misc_feature (162)..(162): location 162 can be absent or Gly
  Misc_feature (163)..(163): location 163 can be absent or Gln
  Misc_feature (164)..(164): location 164 can be absent or Gln
  Misc_feature (165)..(165): location 165 can be absent or Gln
  Misc_feature (166)..(166): location 166 can be absent or Leu
  Misc_feature (167)..(167): location 167 can be absent or Asn
  Misc_feature (168)..(168): location 168 can be absent or Asn
  Misc_feature (169)..(169): location 169 can be absent or Gln
  Misc_feature (170)..(170): location 170 can be absent or Leu
  Misc_feature (171)..(171): location 171 can be absent or Pro
  Misc_feature (172)..(172): location 172 can be absent or Gly
  Misc_feature (173)..(173): location 173 can be absent or Met
  Misc_feature (174)..(174): location 174 can be absent or Ile
  Misc_feature (175)..(175): location 175 can be absent or Gln
  Misc_feature (176)..(176): location 176 can be absent or Pro
  Misc_feature (177)..(177): location 177 can be absent or Phe
  Misc_feature (178)..(178): location 178 can be absent or Pro
  Misc_feature (179)..(179): location 179 can be absent or Arg
  Misc_feature (180)..(180): location 180 can be absent or Gln
  Misc_feature (181)..(181): location 181 can be absent or Gln
  Misc_feature (182)..(182): location 182 can be absent or Met
  Misc_feature (183)..(183): location 183 can be absent or Thr
  Misc_feature (184)..(184): location 184 can be absent or Phe
  Misc_feature (185)..(185): location 185 can be absent or Asn
  Misc_feature (186)..(186): location 186 can be absent or Asp
  Misc_feature (187)..(187): location 187 can be absent or Met
  Misc_feature (188)..(188): location 188 can be absent or Gln
  Misc_feature (189)..(189): location 189 can be absent or Leu
  Misc_feature (190)..(190): location 190 can be absent or Leu
  Misc_feature (191)..(191): location 191 can be absent or Lys
  Misc_feature (192)..(192): location 192 can be absent or Gln
  Misc_feature (193)..(193): location 193 can be absent or His
  Misc_feature (194)..(194): location 194 can be absent or Ala
  Misc_feature (195)..(195): location 195 can be absent or Met
  Misc_feature (196)..(196): location 196 can be absent or Ala
  Misc_feature (197)..(197): location 197 can be absent or Lys
  Misc_feature (198)..(198): location 198 can be absent or Gln
  Misc_feature (199)..(199): location 199 can be absent or Met
  Misc_feature (200)..(200): location 200 can be absent or His
  Misc_feature (201)..(201): location 201 can be absent or Glu
  Misc_feature (202)..(202): location 202 can be absent or Tyr
  Misc_feature (203)..(203): location 203 can be absent or Gln
  Misc_feature (204)..(204): location 204 can be absent or Ile
  Misc_feature (205)..(205): location 205 can be absent or Gln
  Misc_feature (206)..(206): location 206 can be absent or Gln
  Misc_feature (207)..(207): location 207 can be absent or Gln
  Misc_feature (208)..(208): location 208 can be absent or Leu
  Misc_feature (209)..(209): location 209 can be absent or Gln
  Misc_feature (210)..(210): location 210 can be absent or Lys
  Misc_feature (211)..(211): location 211 can be absent or Gln
  Misc_feature (212)..(212): location 212 can be absent or Gln
  Misc_feature (213)..(213): location 213 can be absent or Leu
  Misc_feature (214)..(214): location 214 can be absent or Glu
  Misc_feature (215)..(215): location 215 can be absent or Ala
  Misc_feature (216)..(216): location 216 can be absent or Arg
  Misc_feature (217)..(217): location 217 can be absent or Gln
  Misc_feature (218)..(218): location 218 can be absent or Leu
  Misc_feature (219)..(219): location 219 can be absent or Asn
  Misc_feature (220)..(220): location 220 can be absent or Ser
  Misc_feature (221)..(221): location 221 can be absent or Leu
  Misc_feature (222)..(222): location 222 can be absent or His
  Misc_feature (223)..(223): location 223 can be absent or Ser
  Misc_feature (224)..(224): location 224 can be absent or Asn
  Misc_feature (225)..(225): location 225 can be absent or Ala
  Misc_feature (226)..(226): location 226 can be absent or Val
  Misc_feature (227)..(227): location 227 can be absent or Asn
  Misc_feature (228)..(228): location 228 can be absent or Gly
  Misc_feature (229)..(229): location 229 can be absent or Ser
  Misc_feature (230)..(230): location 230 can be absent or Leu
  Misc_feature (231)..(231): location 231 can be absent or Ser
  Misc_feature (232)..(232): location 232 can be absent or Ser
  Misc_feature (233)..(233): location 233 can be absent or Asp
  Misc_feature (234)..(234): location 234 can be absent or Asn
  Misc_feature (235)..(235): location 235 can be absent or Gln
  Misc_feature (236)..(236): location 236 can be absent or Ser
  Misc_feature (237)..(237): location 237 can be absent or His
  Misc_feature (238)..(238): location 238 can be absent or Pro
  Misc_feature (239)..(239): location 239 can be absent or Ser
  Misc_feature (240)..(240): location 240 can be absent or Ile
  Misc_feature (241)..(241): location 241 can be absent or Ser
  Misc_feature (242)..(242): location 242 can be absent or Gly
  Misc_feature (243)..(243): location 243 can be absent or Val
  Misc_feature (244)..(244): location 244 can be absent or Pro
  Misc_feature (245)..(245): location 245 can be absent or Leu
  Misc_feature (246)..(246): location 246 can be absent or Gln
  Misc_feature (247)..(247): location 247 can be absent or Asp
  Misc_feature (248)..(248): location 248 can be absent or Ala
  Misc_feature (249)..(249): location 249 can be absent or Ser
  Misc_feature (250)..(250): location 250 can be absent or Asn
  Misc_feature (251)..(251): location 251 can be absent or Asn
  Misc_feature (252)..(252): location 252 can be absent or Trp
  Misc_feature (253)..(253): location 253 can be absent or Leu
  Misc_feature (254)..(254): location 254 can be absent or Gln
  Misc_feature (255)..(255): location 255 can be absent or Pro
  Misc_feature (256)..(256): location 256 can be absent or Asp
  Misc_feature (257)..(257): location 257 can be absent or Leu
  Misc_feature (258)..(258): location 258 can be absent or Met
  Misc_feature (259)..(259): location 259 can be absent or Thr
  Misc_feature (260)..(260): location 260 can be absent or Gly
  Misc_feature (261)..(261): location 261 can be absent or Asn
  Misc_feature (262)..(262): location 262 can be absent or Thr
  Misc_feature (263)..(263): location 263 can be absent or Asn
  Misc_feature (264)..(264): location 264 can be absent or Trp
  Misc_feature (265)..(265): location 265 can be absent or Met
  Misc_feature (266)..(266): location 266 can be absent or His
  Misc_feature (267)..(267): location 267 can be absent or Arg
  Misc_feature (268)..(268): location 268 can be absent or Gly
  Misc_feature (269)..(269): location 269 can be absent or Ile
  Misc_feature (270)..(270): location 270 can be absent or Ser
  Misc_feature (271)..(271): location 271 can be absent or Pro
  Misc_feature (272)..(272): location 272 can be absent or Ile
  Misc_feature (273)..(273): location 273 can be absent or Val
  Misc_feature (274)..(274): location 274 can be absent or Gln
  Misc_feature (275)..(275): location 275 can be absent or Ser
  Misc_feature (276)..(276): location 276 can be absent or Ser
  Misc_feature (277)..(277): location 277 can be absent or Ser
  Misc_feature (278)..(278): location 278 can be absent or Ser
  Misc_feature (279)..(279): location 279 can be absent or Gly
  Misc_feature (280)..(280): location 280 can be absent or Leu
  Misc_feature (281)..(281): location 281 can be absent or Val
  Misc_feature (282)..(282): location 282 can be absent or Ile
  Misc_feature (283)..(283): location 283 can be absent or Thr
  Misc_feature (284)..(284): location 284 can be absent or Pro
  Misc_feature (285)..(285): location 285 can be absent or Glu
  Misc_feature (286)..(286): location 286 can be absent or His
  Misc_feature (287)..(287): location 287 can be absent or Gly
  Misc_feature (288)..(288): location 288 can be absent or His
  Misc_feature (289)..(289): location 289 can be absent or Ala
  Misc_feature (290)..(290): location 290 can be absent or Asn
  Misc_feature (291)..(291): location 291 can be absent or Leu
  Misc_feature (292)..(292): location 292 can be absent or Met
  Misc_feature (293)..(293): location 293 can be absent or Ala
  Misc_feature (294)..(294): location 294 can be absent or Gln
  Misc_feature (295)..(295): location 295 can be absent or Gln
  Misc_feature (296)..(296): location 296 can be absent or Phe
  Misc_feature (297)..(297): location 297 can be absent or Glu
  Misc_feature (298)..(298): location 298 can be absent or Thr
  Misc_feature (299)..(299): location 299 can be absent or Ser
  Misc_feature (300)..(300): location 300 can be absent or Leu
  Misc_feature (301)..(301): location 301 can be absent or Tyr
  Misc_feature (302)..(302): location 302 can be absent or Gly
  Misc_feature (303)..(303): location 303 can be absent or Met
  Misc_feature (304)..(304): location 304 can be absent or Pro
  Misc_feature (305)..(305): location 305 can be absent or Val
  Misc_feature (306)..(306): location 306 can be absent or Gly
  Misc_feature (307)..(307): location 307 can be absent or Gly
  Misc_feature (308)..(308): location 308 can be absent or Thr
  Misc_feature (309)..(309): location 309 can be absent or Asp
  Misc_feature (310)..(310): location 310 can be absent or Ala
  Misc_feature (311)..(311): location 311 can be absent or Pro
  Misc_feature (312)..(312): location 312 can be absent or Gln
  Misc_feature (313)..(313): location 313 can be absent or Asn
  Misc_feature (314)..(314): location 314 can be absent or Ala
  Misc_feature (315)..(315): location 315 can be absent or Phe
  Misc_feature (316)..(316): location 316 can be absent or Ser
  Misc_feature (317)..(317): location 317 can be absent or Ser
  Misc_feature (318)..(318): location 318 can be absent or Phe
  Misc_feature (319)..(319): location 319 can be absent or Gln
  Misc_feature (320)..(320): location 320 can be absent or Met
  Misc_feature (321)..(321): location 321 can be absent or Lys
  Misc_feature (322)..(322): location 322 can be absent or Met
  Misc_feature (323)..(323): location 323 can be absent or Leu
  Misc_feature (324)..(324): location 324 can be absent or Ala
  Misc_feature (325)..(325): location 325 can be absent or Ala
  Misc_feature (326)..(326): location 326 can be absent or Gln
  Misc_feature (327)..(327): location 327 can be absent or His
  Misc_feature (328)..(328): location 328 can be absent or Gly
  Misc_feature (329)..(329): location 329 can be absent or Ser
  Misc_feature (330)..(330): location 330 can be absent or Ala
  Misc_feature (331)..(331): location 331 can be absent or Asn
  Misc_feature (332)..(332): location 332 can be absent or Met
  Misc_feature (333)..(333): location 333 can be absent or Ser
  Misc_feature (334)..(334): location 334 can be absent or Ser
  Misc_feature (335)..(335): location 335 can be absent or Ser
  Misc_feature (336)..(336): location 336 can be absent or Leu
  Misc_feature (337)..(337): location 337 can be absent or Thr
  Misc_feature (338)..(338): location 338 can be absent or Asn
  Misc_feature (339)..(339): location 339 can be absent or Gln
  Misc_feature (340)..(340): location 340 can be absent or Pro
  Misc_feature (341)..(341): location 341 can be absent or Thr
  Misc_feature (342)..(342): location 342 can be absent or Ser
  Misc_feature (343)..(343): location 343 can be absent or Phe
  Misc_feature (344)..(344): location 344 can be absent or Leu
  Misc_feature (345)..(345): location 345 can be absent or Asn
  Misc_feature (346)..(346): location 346 can be absent or Gln
  Misc_feature (347)..(347): location 347 can be absent or Ser
  Misc_feature (348)..(348): location 348 can be absent or Asp
  Misc_feature (349)..(349): location 349 can be absent or Ser
  Misc_feature (350)..(350): location 350 can be absent or His
  Misc_feature (351)..(351): location 351 can be absent or Met
  Misc_feature (352)..(352): location 352 can be absent or Leu
  Misc_feature (353)..(353): location 353 can be absent or Pro
  Misc_feature (354)..(354): location 354 can be absent or Arg
  Misc_feature (355)..(355): location 355 can be absent or Ser
  Misc_feature (356)..(356): location 356 can be absent or Thr
  Misc_feature (357)..(357): location 357 can be absent or Tyr
  Misc_feature (358)..(358): location 358 can be absent or Gln
  Misc_feature (359)..(359): location 359 can be absent or Glu
  Misc_feature (360)..(360): location 360 can be absent or Asn
  Misc_feature (361)..(361): location 361 can be absent or Leu
  Misc_feature (362)..(362): location 362 can be absent or Tyr
  Misc_feature (363)..(363): location 363 can be absent or Ser
  Misc_feature (364)..(364): location 364 can be absent or His
  Misc_feature (365)..(365): location 365 can be absent or Ile
  Misc_feature (366)..(366): location 366 can be absent or Ser
  Misc_feature (367)..(367): location 367 can be absent or Val
  Misc_feature (368)..(368): location 368 can be absent or Pro
  Misc_feature (369)..(369): location 369 can be absent or Gly
  Misc_feature (370)..(370): location 370 can be absent or Ser
  Misc_feature (371)..(371): location 371 can be absent or Asn
  Misc_feature (372)..(372): location 372 can be absent or Asp
  Misc_feature (373)..(373): location 373 can be absent or Arg
  Misc_feature (374)..(374): location 374 can be absent or Pro
  Misc_feature (375)..(375): location 375 can be absent or Asn
  Misc_feature (376)..(376): location 376 can be absent or Phe
  Misc_feature (377)..(377): location 377 can be absent or Glu
  Misc_feature (378)..(378): location 378 can be absent or Ser
  Misc_feature (379)..(379): location 379 can be absent or Phe
  Misc_feature (380)..(380): location 380 can be absent or Gln
  Misc_feature (381)..(381): location 381 can be absent or Gln
  Misc_feature (382)..(382): location 382 can be absent or Asp
  Misc_feature (383)..(383): location 383 can be absent or Asn
  Misc_feature (384)..(384): location 384 can be absent or Ser
  Misc_feature (385)..(385): location 385 can be absent or Gly
  Misc_feature (386)..(386): location 386 can be absent or Gln
  Misc_feature (387)..(387): location 387 can be absent or Gln
  Misc_feature (388)..(388): location 388 can be absent or Asn
  Misc_feature (389)..(389): location 389 can be absent or Ile
  Misc_feature (390)..(390): location 390 can be absent or Ser
  Misc_feature (391)..(391): location 391 can be absent or Gly
  Misc_feature (392)..(392): location 392 can be absent or Gln
  Misc_feature (393)..(393): location 393 can be absent or Glu
  Misc_feature (394)..(394): location 394 can be absent or Glu
  Misc_feature (395)..(395): location 395 can be absent or Phe
  Misc_feature (396)..(396): location 396 can be absent or Gly
  Misc_feature (397)..(397): location 397 can be absent or Gln
  Misc_feature (398)..(398): location 398 can be absent or Met
  Misc_feature (399)..(399): location 399 can be absent or Asp
  Misc_feature (400)..(400): location 400 can be absent or Gly
  Misc_feature (401)..(401): location 401 can be absent or Ser
  Misc_feature (402)..(402): location 402 can be absent or Gly
  Misc_feature (403)..(403): location 403 can be absent or Leu
  Misc_feature (404)..(404): location 404 can be absent or Ser
  Misc_feature (405)..(405): location 405 can be absent or Glu
  Misc_feature (406)..(406): location 406 can be absent or Lys
  Misc_feature (407)..(407): location 407 can be absent or Ser
  Misc_feature (408)..(408): location 408 can be absent or Phe
  Misc_feature (409)..(409): location 409 can be absent or Met
  Misc_feature (410)..(410): location 410 can be absent or Lys
  Misc_feature (411)..(411): location 411 can be absent or Val
  Misc_feature (412)..(412): location 412 can be absent or Pro
  Misc_feature (413)..(413): location 413 can be absent or Glu
  Misc_feature (414)..(414): location 414 can be absent or Asn
  Misc_feature (415)..(415): location 415 can be absent or Ile
  Misc_feature (416)..(416): location 416 can be absent or Asn
  Misc_feature (417)..(417): location 417 can be absent or Thr
  Misc_feature (418)..(418): location 418 can be absent or Leu
  Misc_feature (419)..(419): location 419 can be absent or Gln
  Misc_feature (420)..(420): location 420 can be absent or Lys
  Misc_feature (421)..(421): location 421 can be absent or Ser
  Misc_feature (422)..(422): location 422 can be absent or Thr
  Misc_feature (423)..(423): location 423 can be absent or Thr
  Misc_feature (424)..(424): location 424 can be absent or Leu
  Misc_feature (425)..(425): location 425 can be absent or Asp
  Misc_feature (426)..(426): location 426 can be absent or Pro
  Misc_feature (427)..(427): location 427 can be absent or Thr
  Misc_feature (428)..(428): location 428 can be absent or Glu
  Misc_feature (429)..(429): location 429 can be absent or Glu
  Misc_feature (430)..(430): location 430 can be absent or Lys
  Misc_feature (431)..(431): location 431 can be absent or Ile
  Misc_feature (432)..(432): location 432 can be absent or Leu
  Misc_feature (433)..(433): location 433 can be absent or Phe
  Misc_feature (434)..(434): location 434 can be absent or Gly
  Misc_feature (435)..(435): location 435 can be absent or Ser
  Misc_feature (436)..(436): location 436 can be absent or Asp
  Misc_feature (437)..(437): location 437 can be absent or Asp
  Misc_feature (438)..(438): location 438 can be absent or Asn
  Misc_feature (439)..(439): location 439 can be absent or Leu
  Misc_feature (440)..(440): location 440 can be absent or Trp
  Misc_feature (441)..(441): location 441 can be absent or Glu
  Misc_feature (442)..(442): location 442 can be absent or Ala
  Misc_feature (443)..(443): location 443 can be absent or Phe
  Misc_feature (444)..(444): location 444 can be absent or Gly
  Misc_feature (445)..(445): location 445 can be absent or Asn
  Misc_feature (446)..(446): location 446 can be absent or Ser
  Misc_feature (447)..(447): location 447 can be absent or Thr
  Misc_feature (448)..(448): location 448 can be absent or Asp
  Misc_feature (449)..(449): location 449 can be absent or Met
  Misc_feature (450)..(450): location 450 can be absent or Ser
  Misc_feature (451)..(451): location 451 can be absent or Leu
  Misc_feature (452)..(452): location 452 can be absent or Thr
  Misc_feature (453)..(453): location 453 can be absent or Gly
  Misc_feature (454)..(454): location 454 can be absent or Asn
  Misc_feature (455)..(455): location 455 can be absent or Leu
  Misc_feature (456)..(456): location 456 can be absent or Met
  Misc_feature (457)..(457): location 457 can be absent or Ser
  Misc_feature (458)..(458): location 458 can be absent or Ser
  Misc_feature (459)..(459): location 459 can be absent or Ser
  Misc_feature (460)..(460): location 460 can be absent or Ser
  Misc_feature (461)..(461): location 461 can be absent or Asp
  Misc_feature (462)..(462): location 462 can be absent or Leu
  Misc_feature (463)..(463): location 463 can be absent or Phe
  Misc_feature (464)..(464): location 464 can be absent or Asp
  Misc_feature (465)..(465): location 465 can be absent or Ala
  Misc_feature (466)..(466): location 466 can be absent or Cys
  Misc_feature (467)..(467): location 467 can be absent or Pro
  Misc_feature (468)..(468): location 468 can be absent or Ser
  Misc_feature (469)..(469): location 469 can be absent or Leu
  Misc_feature (470)..(470): location 470 can be absent or Gln
  Misc_feature (471)..(471): location 471 can be absent or Ser
  Misc_feature (472)..(472): location 472 can be absent or Gly
  Misc_feature (473)..(473): location 473 can be absent or Ser
  Misc_feature (474)..(474): location 474 can be absent or Trp
  Misc_feature (475)..(475): location 475 can be absent or Ser
  Misc_feature (476)..(476): location 476 can be absent or Ala
  Misc_feature (477)..(477): location 477 can be absent or Leu
  Misc_feature (478)..(478): location 478 can be absent or Met
  Misc_feature (479)..(479): location 479 can be absent or Gln
  Misc_feature (480)..(480): location 480 can be absent or Ser
  Misc_feature (481)..(481): location 481 can be absent or Ala
  Misc_feature (482)..(482): location 482 can be absent or Val
  Misc_feature (483)..(483): location 483 can be absent or Ala
  Misc_feature (484)..(484): location 484 can be absent or Glu
  Misc_feature (485)..(485): location 485 can be absent or Thr
  Misc_feature (486)..(486): location 486 can be absent or Ala
  Misc_feature (487)..(487): location 487 can be absent or Ser
  Misc_feature (488)..(488): location 488 can be absent or Asp
  Misc_feature (489)..(489): location 489 can be absent or Asp
  Misc_feature (490)..(490): location 490 can be absent or Ala
  Misc_feature (491)..(491): location 491 can be absent or Gly
  Misc_feature (492)..(492): location 492 can be absent or Val
  Misc_feature (493)..(493): location 493 can be absent or His
  Misc_feature (494)..(494): location 494 can be absent or Glu
  Misc_feature (495)..(495): location 495 can be absent or Trp
  Misc_feature (496)..(496): location 496 can be absent or Gly
  Misc_feature (497)..(497): location 497 can be absent or Ser
  Misc_feature (498)..(498): location 498 can be absent or Lys
  Misc_feature (499)..(499): location 499 can be absent or Gln
  Misc_feature (500)..(500): location 500 can be absent or Gln
  Misc_feature (501)..(501): location 501 can be absent or Ser
  Misc_feature (502)..(502): location 502 can be absent or Val
  Misc_feature (503)..(503): location 503 can be absent or Trp
  Misc_feature (504)..(504): location 504 can be absent or Ala
  Misc_feature (505)..(505): location 505 can be absent or Asn
  Misc_feature (506)..(506): location 506 can be absent or Asn
  Misc_feature (507)..(507): location 507 can be absent or Ile
  Misc_feature (508)..(508): location 508 can be absent or Asn
  Misc_feature (509)..(509): location 509 can be absent or Ala
  Misc_feature (510)..(510): location 510 can be absent or Pro
  Misc_feature (511)..(511): location 511 can be absent or His
  Misc_feature (512)..(512): location 512 can be absent or Pro
  Misc_feature (513)..(513): location 513 can be absent or Asp
  Misc_feature (514)..(514): location 514 can be absent or Ser
  Misc_feature (515)..(515): location 515 can be absent or Arg
  Misc_feature (516)..(516): location 516 can be absent or Ile
  Misc_feature (517)..(517): location 517 can be absent or Gly
  Misc_feature (518)..(518): location 518 can be absent or Asn
  Misc_feature (519)..(519): location 519 can be absent or Arg
  Misc_feature (520)..(520): location 520 can be absent or Ala
  Misc_feature (521)..(521): location 521 can be absent or Gln
  Misc_feature (522)..(522): location 522 can be absent or Val
  Misc_feature (523)..(523): location 523 can be absent or Ser
  Misc_feature (524)..(524): location 524 can be absent or Gly
  Misc_feature (525)..(525): location 525 can be absent or Gly
  Misc_feature (526)..(526): location 526 can be absent or His
  Misc_feature (527)..(527): location 527 can be absent or Thr
  Misc_feature (528)..(528): location 528 can be absent or Asp
  Misc_feature (529)..(529): location 529 can be absent or Ser
  Misc_feature (530)..(530): location 530 can be absent or Thr
  Misc_feature (531)..(531): location 531 can be absent or Arg
  Misc_feature (532)..(532): location 532 can be absent or Ser
  Misc_feature (533)..(533): location 533 can be absent or Thr
  Misc_feature (534)..(534): location 534 can be absent or Val
  Misc_feature (535)..(535): location 535 can be absent or Gln
  Misc_feature (536)..(536): location 536 can be absent or His
  Misc_feature (537)..(537): location 537 can be absent or Leu
  Misc_feature (538)..(538): location 538 can be absent or Gln
  Misc_feature (539)..(539): location 539 can be absent or Asp
  Misc_feature (540)..(540): location 540 can be absent or Lys
  Misc_feature (541)..(541): location 541 can be absent or Gly
  Misc_feature (542)..(542): location 542 can be absent or Asn
  Misc_feature (543)..(543): location 543 can be absent or Ile
  Misc_feature (544)..(544): location 544 can be absent or Val
  Misc_feature (545)..(545): location 545 can be absent or Ser
  Misc_feature (546)..(546): location 546 can be absent or Asp
  Misc_feature (547)..(547): location 547 can be absent or His
  Misc_feature (548)..(548): location 548 can be absent or Gly
  Misc_feature (549)..(549): location 549 can be absent or Leu
  Misc_feature (550)..(550): location 550 can be absent or Leu
  Misc_feature (551)..(551): location 551 can be absent or Glu
  Misc_feature (552)..(552): location 552 can be absent or Lys
  Misc_feature (553)..(553): location 553 can be absent or Pro
  Misc_feature (554)..(554): location 554 can be absent or Met
  Misc_feature (555)..(555): location 555 can be absent or Thr
  Misc_feature (556)..(556): location 556 can be absent or Pro
  Misc_feature (557)..(557): location 557 can be absent or Gln
  Misc_feature (558)..(558): location 558 can be absent or Ser
  Misc_feature (559)..(559): location 559 can be absent or Gln
  Misc_feature (560)..(560): location 560 can be absent or Met
  Misc_feature (561)..(561): location 561 can be absent or Ala
  Misc_feature (562)..(562): location 562 can be absent or Gly
  Misc_feature (563)..(563): location 563 can be absent or Asn
  Misc_feature (564)..(564): location 564 can be absent or Met
  Misc_feature (565)..(565): location 565 can be absent or Phe
  Misc_feature (566)..(566): location 566 can be absent or Gln
  Misc_feature (567)..(567): location 567 can be absent or Ser
  Misc_feature (568)..(568): location 568 can be absent or Leu
  Misc_feature (569)..(569): location 569 can be absent or Ser
  Misc_feature (570)..(570): location 570 can be absent or Ser
  Misc_feature (571)..(571): location 571 can be absent or Gly
  Misc_feature (572)..(572): location 572 can be absent or Ile
  Misc_feature (573)..(573): location 573 can be absent or Asp
  Misc_feature (574)..(574): location 574 can be absent or Val
  Misc_feature (575)..(575): location 575 can be absent or Gln
  Misc_feature (576)..(576): location 576 can be absent or Asn
  Misc_feature (577)..(577): location 577 can be absent or Asn
  Misc_feature (578)..(578): location 578 can be absent or Ser
  Misc_feature (579)..(579): location 579 can be absent or Cys
  Misc_feature (580)..(580): location 580 can be absent or Ser
  Misc_feature (581)..(581): location 581 can be absent or Ile
  Misc_feature (582)..(582): location 582 can be absent or Gly
  Misc_feature (583)..(583): location 583 can be absent or Lys
  Misc_feature (584)..(584): location 584 can be absent or Asn
  Misc_feature (585)..(585): location 585 can be absent or Glu
  Misc_feature (586)..(586): location 586 can be absent or Asp
  Misc_feature (587)..(587): location 587 can be absent or Ile
  Misc_feature (588)..(588): location 588 can be absent or Asp
  Misc_feature (589)..(589): location 589 can be absent or Asp
  Misc_feature (590)..(590): location 590 can be absent or Arg
  Misc_feature (591)..(591): location 591 can be absent or Leu
  Misc_feature (592)..(592): location 592 can be absent or Gly
  Misc_feature (593)..(593): location 593 can be absent or Asn
  Misc_feature (594)..(594): location 594 can be absent or Trp
  Misc_feature (595)..(595): location 595 can be absent or Arg
  Misc_feature (596)..(596): location 596 can be absent or Gly
  Misc_feature (597)..(597): location 597 can be absent or Ala
  Misc_feature (598)..(598): location 598 can be absent or Ser
  Misc_feature (599)..(599): location 599 can be absent or Asn
  Misc_feature (600)..(600): location 600 can be absent or Pro
  Misc_feature (601)..(601): location 601 can be absent or Asn
  Misc_feature (602)..(602): location 602 can be absent or Ser
  Misc_feature (603)..(603): location 603 can be absent or Ala
  Misc_feature (604)..(604): location 604 can be absent or Ala
  Misc_feature (605)..(605): location 605 can be absent or Leu
  Misc_feature (606)..(606): location 606 can be absent or Met
  Misc_feature (607)..(607): location 607 can be absent or Glu
  Misc_feature (608)..(608): location 608 can be absent or Arg
  Misc_feature (609)..(609): location 609 can be absent or Lys
  Misc_feature (610)..(610): location 610 can be absent or Asn
  Misc_feature (611)..(611): location 611 can be absent or His
  Misc_feature (612)..(612): location 612 can be absent or Phe
  Misc_feature (613)..(613): location 613 can be absent or Thr
  Misc_feature (614)..(614): location 614 can be absent or Gln
  Misc_feature (615)..(615): location 615 can be absent or Asn
  Misc_feature (616)..(616): location 616 can be absent or Leu
  Misc_feature (617)..(617): location 617 can be absent or Gln
  Misc_feature (618)..(618): location 618 can be absent or Met
  Misc_feature (619)..(619): location 619 can be absent or Gln
  Misc_feature (620)..(620): location 620 can be absent or Arg
  Misc_feature (621)..(621): location 621 can be absent or Ala
  Misc_feature (622)..(622): location 622 can be absent or Ser
  Misc_feature (623)..(623): location 623 can be absent or Tyr
  Misc_feature (624)..(624): location 624 can be absent or Gly
  Misc_feature (625)..(625): location 625 can be absent or Ala
  Misc_feature (626)..(626): location 626 can be absent or Gly
  Misc_feature (627)..(627): location 627 can be absent or Asp
  Misc_feature (628)..(628): location 628 can be absent or Asp
  Misc_feature (629)..(629): location 629 can be absent or Ser
  Misc_feature (630)..(630): location 630 can be absent or Arg
  Misc_feature (631)..(631): location 631 can be absent or Ala
  Misc_feature (632)..(632): location 632 can be absent or Ser
  Misc_feature (633)..(633): location 633 can be absent or Arg
  Misc_feature (634)..(634): location 634 can be absent or Asp
  Misc_feature (635)..(635): location 635 can be absent or Ile
  Misc_feature (636)..(636): location 636 can be absent or Gln
  Misc_feature (637)..(637): location 637 can be absent or Gln
  Misc_feature (638)..(638): location 638 can be absent or Asn
  Misc_feature (639)..(639): location 639 can be absent or Ile
  Misc_feature (640)..(640): location 640 can be absent or Gln
  Misc_feature (641)..(641): location 641 can be absent or His
  Misc_feature (642)..(642): location 642 can be absent or His
  Misc_feature (643)..(643): location 643 can be absent or Leu
  Misc_feature (644)..(644): location 644 can be absent or Asp
  Misc_feature (645)..(645): location 645 can be absent or Asn
  Misc_feature (646)..(646): location 646 can be absent or Asn
  Misc_feature (647)..(647): location 647 can be absent or Ser
  Misc_feature (648)..(648): location 648 can be absent or Val
  Misc_feature (649)..(649): location 649 can be absent or Glu
  Misc_feature (650)..(650): location 650 can be absent or Lys
  Misc_feature (651)..(651): location 651 can be absent or Ala
  Misc_feature (652)..(652): location 652 can be absent or Ile
  Misc_feature (653)..(653): location 653 can be absent or His
  Misc_feature (654)..(654): location 654 can be absent or Gln
  Misc_feature (655)..(655): location 655 can be absent or Leu
  Misc_feature (656)..(656): location 656 can be absent or Asn
  Misc_feature (657)..(657): location 657 can be absent or Ser
  Misc_feature (658)..(658): location 658 can be absent or Gly
  Misc_feature (659)..(659): location 659 can be absent or Asp
  Misc_feature (660)..(660): location 660 can be absent or Ser
  Misc_feature (661)..(661): location 661 can be absent or Ser
  Misc_feature (662)..(662): location 662 can be absent or Gln
  Misc_feature (663)..(663): location 663 can be absent or Ile
  Misc_feature (664)..(664): location 664 can be absent or Leu
  Misc_feature (665)..(665): location 665 can be absent or Glu
  Misc_feature (666)..(666): location 666 can be absent or Ser
  Misc_feature (667)..(667): location 667 can be absent or Tyr
  Misc_feature (668)..(668): location 668 can be absent or Ala
  Misc_feature (669)..(669): location 669 can be absent or Ser
  Misc_feature (670)..(670): location 670 can be absent or Asn
  Misc_feature (671)..(671): location 671 can be absent or Asn
  Misc_feature (672)..(672): location 672 can be absent or Val
  Misc_feature (673)..(673): location 673 can be absent or Ser
  Misc_feature (674)..(674): location 674 can be absent or Lys
  Misc_feature (675)..(675): location 675 can be absent or Val
  Misc_feature (676)..(676): location 676 can be absent or Met
  Misc_feature (677)..(677): location 677 can be absent or Thr
  Misc_feature (678)..(678): location 678 can be absent or Glu
  Misc_feature (679)..(679): location 679 can be absent or Ser
  Misc_feature (680)..(680): location 680 can be absent or Asn
  Misc_feature (681)..(681): location 681 can be absent or Glu
  Misc_feature (682)..(682): location 682 can be absent or Met
  Misc_feature (683)..(683): location 683 can be absent or Gly
  Misc_feature (684)..(684): location 684 can be absent or Asn
  Misc_feature (685)..(685): location 685 can be absent or Ser
  Misc_feature (686)..(686): location 686 can be absent or Gly
  Misc_feature (687)..(687): location 687 can be absent or Lys
  Misc_feature (688)..(688): location 688 can be absent or Glu
  Misc_feature (689)..(689): location 689 can be absent or Asn
  Misc_feature (690)..(690): location 690 can be absent or Ser
  Misc_feature (691)..(691): location 691 can be absent or Ser
  Misc_feature (692)..(692): location 692 can be absent or Asp
  Misc_feature (693)..(693): location 693 can be absent or Ser
  Misc_feature (694)..(694): location 694 can be absent or Phe
  Misc_feature (695)..(695): location 695 can be absent or Arg
  Misc_feature (696)..(696): location 696 can be absent or Ser
  Misc_feature (697)..(697): location 697 can be absent or Lys
  Misc_feature (698)..(698): location 698 can be absent or Phe
  Misc_feature (699)..(699): location 699 can be absent or Ser
  Misc_feature (700)..(700): location 700 can be absent or Pro
  Misc_feature (701)..(701): location 701 can be absent or Glu
  Misc_feature (702)..(702): location 702 can be absent or Ser
  Misc_feature (703)..(703): location 703 can be absent or Leu
  Misc_feature (704)..(704): location 704 can be absent or Thr
  Misc_feature (705)..(705): location 705 can be absent or Gln
  Misc_feature (706)..(706): location 706 can be absent or Val
  Misc_feature (707)..(707): location 707 can be absent or Asn
  Misc_feature (708)..(708): location 708 can be absent or Ala
  Misc_feature (709)..(709): location 709 can be absent or Arg
  Misc_feature (710)..(710): location 710 can be absent or Asp
  Misc_feature (711)..(711): location 711 can be absent or Leu
  Misc_feature (712)..(712): location 712 can be absent or Ser
  Misc_feature (713)..(713): location 713 can be absent or Val
  Misc_feature (714)..(714): location 714 can be absent or Leu
  Misc_feature (715)..(715): location 715 can be absent or Pro
  Misc_feature (716)..(716): location 716 can be absent or Gly
  Misc_feature (717)..(717): location 717 can be absent or Gly
  Misc_feature (718)..(718): location 718 can be absent or Lys
  Misc_feature (719)..(719): location 719 can be absent or Glu
  Misc_feature (720)..(720): location 720 can be absent or Thr
  Misc_feature (721)..(721): location 721 can be absent or Gln
  Misc_feature (722)..(722): location 722 can be absent or Ser
  Misc_feature (723)..(723): location 723 can be absent or Pro
  Misc_feature (724)..(724): location 724 can be absent or Ser
  Misc_feature (725)..(725): location 725 can be absent or Arg
  Misc_feature (726)..(726): location 726 can be absent or Ser
  Misc_feature (727)..(727): location 727 can be absent or Asp
  Misc_feature (728)..(728): location 728 can be absent or Gly
  Misc_feature (729)..(729): location 729 can be absent or Leu
  Misc_feature (730)..(730): location 730 can be absent or Ile
  Misc_feature (731)..(731): location 731 can be absent or Arg
  Misc_feature (732)..(732): location 732 can be absent or Asp
  Misc_feature (733)..(733): location 733 can be absent or Gly
  Misc_feature (734)..(734): location 734 can be absent or Leu
  Misc_feature (735)..(735): location 735 can be absent or Asn
  Misc_feature (736)..(736): location 736 can be absent or His
  Misc_feature (737)..(737): location 737 can be absent or Lys
  Misc_feature (738)..(738): location 738 can be absent or Asp
  Misc_feature (739)..(739): location 739 can be absent or Ser
  Misc_feature (740)..(740): location 740 can be absent or Ala
  Misc_feature (741)..(741): location 741 can be absent or Asn
  Misc_feature (742)..(742): location 742 can be absent or Cys
  Misc_feature (743)..(743): location 743 can be absent or Met
  Misc_feature (744)..(744): location 744 can be absent or Leu
  Misc_feature (745)..(745): location 745 can be absent or Gln
  Misc_feature (746)..(746): location 746 can be absent or Phe
  Misc_feature (747)..(747): location 747 can be absent or Gly
  Misc_feature (748)..(748): location 748 can be absent or Pro
  Misc_feature (749)..(749): location 749 can be absent or Thr
  Misc_feature (750)..(750): location 750 can be absent or Ile
  Misc_feature (751)..(751): location 751 can be absent or Ser
  Misc_feature (752)..(752): location 752 can be absent or Gln
  Misc_feature (753)..(753): location 753 can be absent or Ser
  Misc_feature (754)..(754): location 754 can be absent or Phe
  Misc_feature (755)..(755): location 755 can be absent or Phe
  Misc_feature (756)..(756): location 756 can be absent or Asn
  Misc_feature (757)..(757): location 757 can be absent or Lys
  Misc_feature (758)..(758): location 758 can be absent or Asn
  Misc_feature (759)..(759): location 759 can be absent or His
  Misc_feature (760)..(760): location 760 can be absent or Ala
  Misc_feature (761)..(761): location 761 can be absent or Val
  Misc_feature (762)..(762): location 762 can be absent or Ser
  Misc_feature (763)..(763): location 763 can be absent or Ala
  Misc_feature (764)..(764): location 764 can be absent or Gly
  Misc_feature (765)..(765): location 765 can be absent or Ser
  Misc_feature (766)..(766): location 766 can be absent or Asp
  Misc_feature (767)..(767): location 767 can be absent or His
  Misc_feature (768)..(768): location 768 can be absent or Gln
  Misc_feature (769)..(769): location 769 can be absent or Gln
  Misc_feature (770)..(770): location 770 can be absent or Ile
  Misc_feature (771)..(771): location 771 can be absent or Ser
  Misc_feature (772)..(772): location 772 can be absent or Pro
  Misc_feature (773)..(773): location 773 can be absent or Gln
  Misc_feature (774)..(774): location 774 can be absent or Ile
  Misc_feature (775)..(775): location 775 can be absent or Ala
  Misc_feature (776)..(776): location 776 can be absent or Pro
  Misc_feature (777)..(777): location 777 can be absent or Ser
  Misc_feature (778)..(778): location 778 can be absent or Arg
  Misc_feature (779)..(779): location 779 can be absent or Phe
  Misc_feature (780)..(780): location 780 can be absent or Ser
  Misc_feature (781)..(781): location 781 can be absent or Gln
  Misc_feature (782)..(782): location 782 can be absent or Tyr
  Misc_feature (783)..(783): location 783 can be absent or Glu
  Misc_feature (784)..(784): location 784 can be absent or Ala
  Misc_feature (785)..(785): location 785 can be absent or Phe
  Misc_feature (786)..(786): location 786 can be absent or Lys
  Misc_feature (787)..(787): location 787 can be absent or Asn
  Misc_feature (788)..(788): location 788 can be absent or Gly
  Misc_feature (789)..(789): location 789 can be absent or Leu
  Misc_feature (790)..(790): location 790 can be absent or Val
  Misc_feature (791)..(791): location 791 can be absent or Gln
  Misc_feature (792)..(792): location 792 can be absent or Pro
  Misc_feature (793)..(793): location 793 can be absent or Val
  Misc_feature (794)..(794): location 794 can be absent or Asn
  Misc_feature (795)..(795): location 795 can be absent or Asp
  Misc_feature (796)..(796): location 796 can be absent or Thr
  Misc_feature (797)..(797): location 797 can be absent or Gly
  Misc_feature (798)..(798): location 798 can be absent or Arg
  Misc_feature (799)..(799): location 799 can be absent or Phe
  Misc_feature (800)..(800): location 800 can be absent or Thr
  Misc_feature (801)..(801): location 801 can be absent or Leu
  Misc_feature (802)..(802): location 802 can be absent or Leu
  Misc_feature (803)..(803): location 803 can be absent or Lys
  Misc_feature (804)..(804): location 804 can be absent or Ile
  Misc_feature (805)..(805): location 805 can be absent or Gly
  Misc_feature (806)..(806): location 806 can be absent or Glu
  Misc_feature (807)..(807): location 807 can be absent or Arg
  Misc_feature (808)..(808): location 808 can be absent or Tyr
  Misc_feature (809)..(809): location 809 can be absent or Ser
  Misc_feature (810)..(810): location 810 can be absent or Asn
  Misc_feature (811)..(811): location 811 can be absent or Leu
  Misc_feature (812)..(812): location 812 can be absent or Gly
  Misc_feature (813)..(813): location 813 can be absent or Asn
  Misc_feature (814)..(814): location 814 can be absent or Ser
  Misc_feature (815)..(815): location 815 can be absent or Asp
  Misc_feature (816)..(816): location 816 can be absent or Asp
  Misc_feature (817)..(817): location 817 can be absent or Gly
  Misc_feature (818)..(818): location 818 can be absent or Leu
  Misc_feature (819)..(819): location 819 can be absent or His
  Misc_feature (820)..(820): location 820 can be absent or Ser
  Misc_feature (821)..(821): location 821 can be absent or Val
  Misc_feature (822)..(822): location 822 can be absent or Gln
  Misc_feature (823)..(823): location 823 can be absent or Ser
  Misc_feature (824)..(824): location 824 can be absent or Ser
  Misc_feature (825)..(825): location 825 can be absent or Lys
  Misc_feature (826)..(826): location 826 can be absent or Gln
  Misc_feature (827)..(827): location 827 can be absent or Leu
  Misc_feature (828)..(828): location 828 can be absent or Asn
  Misc_feature (829)..(829): location 829 can be absent or Thr
  Misc_feature (830)..(830): location 830 can be absent or Ala
  Misc_feature (831)..(831): location 831 can be absent or Asp
  Misc_feature (832)..(832): location 832 can be absent or Pro
  Misc_feature (833)..(833): location 833 can be absent or Gly
  Misc_feature (834)..(834): location 834 can be absent or Tyr
  Misc_feature (835)..(835): location 835 can be absent or Ile
  Misc_feature (836)..(836): location 836 can be absent or Val
  Misc_feature (837)..(837): location 837 can be absent or His
  Misc_feature (838)..(838): location 838 can be absent or Met
  Misc_feature (839)..(839): location 839 can be absent or Gln
  Misc_feature (840)..(840): location 840 can be absent or Gln
  Misc_feature (841)..(841): location 841 can be absent or Ile
  Misc_feature (842)..(842): location 842 can be absent or Ser
  Misc_feature (843)..(843): location 843 can be absent or Gly
  Misc_feature (844)..(844): location 844 can be absent or Ser
  Misc_feature (845)..(845): location 845 can be absent or Thr
  Misc_feature (846)..(846): location 846 can be absent or Pro
  Misc_feature (847)..(847): location 847 can be absent or Gly
  Misc_feature (848)..(848): location 848 can be absent or Val
  Misc_feature (849)..(849): location 849 can be absent or Glu
  Misc_feature (850)..(850): location 850 can be absent or Thr
  Misc_feature (851)..(851): location 851 can be absent or Leu
  Misc_feature (852)..(852): location 852 can be absent or Ser
  Misc_feature (853)..(853): location 853 can be absent or Ser
  Misc_feature (854)..(854): location 854 can be absent or Ala
  Misc_feature (855)..(855): location 855 can be absent or Ser
  Misc_feature (856)..(856): location 856 can be absent or Leu
  Misc_feature (857)..(857): location 857 can be absent or Pro
  Misc_feature (858)..(858): location 858 can be absent or Cys
  Misc_feature (859)..(859): location 859 can be absent or Gly
  Misc_feature (860)..(860): location 860 can be absent or Ala
  Misc_feature (861)..(861): location 861 can be absent or Thr
  Misc_feature (862)..(862): location 862 can be absent or Asp
  Misc_feature (863)..(863): location 863 can be absent or Gln
  Misc_feature (864)..(864): location 864 can be absent or Leu
  Misc_feature (865)..(865): location 865 can be absent or Leu
  Misc_feature (866)..(866): location 866 can be absent or Lys
  Misc_feature (867)..(867): location 867 can be absent or Val
  Misc_feature (868)..(868): location 868 can be absent or Tyr
  Misc_feature (869)..(869): location 869 can be absent or Lys
  Misc_feature (870)..(870): location 870 can be absent or Pro
  Misc_feature (871)..(871): location 871 can be absent or Lys
  Misc_feature (872)..(872): location 872 can be absent or Lys
  Misc_feature (873)..(873): location 873 can be absent or Arg
  Misc_feature (874)..(874): location 874 can be absent or Lys
  Misc_feature (875)..(875): location 875 can be absent or Asn
  Misc_feature (876)..(876): location 876 can be absent or Val
  Misc_feature (877)..(877): location 877 can be absent or Thr
  Misc_feature (878)..(878): location 878 can be absent or Ser
  Misc_feature (879)..(879): location 879 can be absent or Glu
  Misc_feature (880)..(880): location 880 can be absent or Leu
  Misc_feature (881)..(881): location 881 can be absent or Leu
  Misc_feature (882)..(882): location 882 can be absent or Ser
  Misc_feature (883)..(883): location 883 can be absent or Trp
  Misc_feature (884)..(884): location 884 can be absent or Ser
  Misc_feature (885)..(885): location 885 can be absent or Lys
  Misc_feature (886)..(886): location 886 can be absent or Glu
  Misc_feature (887)..(887): location 887 can be absent or Val
  Misc_feature (888)..(888): location 888 can be absent or Met
  Misc_feature (889)..(889): location 889 can be absent or Gln
  Misc_feature (890)..(890): location 890 can be absent or Arg
  Misc_feature (891)..(891): location 891 can be absent or Pro
  Misc_feature (892)..(892): location 892 can be absent or Gln
  Misc_feature (893)..(893): location 893 can be absent or Arg
  Misc_feature (894)..(894): location 894 can be absent or Leu
  Misc_feature (895)..(895): location 895 can be absent or Lys
  Misc_feature (896)..(896): location 896 can be absent or Thr
  Misc_feature (897)..(897): location 897 can be absent or Leu
  Misc_feature (898)..(898): location 898 can be absent or Gly
  Misc_feature (899)..(899): location 899 can be absent or Phe
  Misc_feature (900)..(900): location 900 can be absent or Leu
  Misc_feature (901)..(901): location 901 can be absent or Phe
  Misc_feature (902)..(902): location 902 can be absent or Glu
  Misc_feature (903)..(903): location 903 can be absent or Ala
  Misc_feature (904)..(904): location 904 can be absent or Glu
  Misc_feature (905)..(905): location 905 can be absent or Val
  Misc_feature (906)..(906): location 906 can be absent or Asp
  Misc_feature (907)..(907): location 907 can be absent or Trp
  Misc_feature (908)..(908): location 908 can be absent or Ala
  Misc_feature (909)..(909): location 909 can be absent or Arg
  Misc_feature (910)..(910): location 910 can be absent or Ala
  Misc_feature (911)..(911): location 911 can be absent or Thr
  Misc_feature (912)..(912): location 912 can be absent or Asn
  Misc_feature (913)..(913): location 913 can be absent or Arg
  Misc_feature (914)..(914): location 914 can be absent or Phe
  Misc_feature (915)..(915): location 915 can be absent or Ala
  Misc_feature (916)..(916): location 916 can be absent or Glu
  Misc_feature (917)..(917): location 917 can be absent or Lys
  Misc_feature (918)..(918): location 918 can be absent or Gly
  Misc_feature (919)..(919): location 919 can be absent or Leu
  Misc_feature (920)..(920): location 920 can be absent or Phe
  Misc_feature (921)..(921): location 921 can be absent or Val
  Misc_feature (922)..(922): location 922 can be absent or Glu
  Misc_feature (923)..(923): location 923 can be absent or Phe
  Misc_feature (924)..(924): location 924 can be absent or Ala
  Misc_feature (925)..(925): location 925 can be absent or Thr
  Misc_feature (926)..(926): location 926 can be absent or Leu
  Misc_feature (927)..(927): location 927 can be absent or Leu
  Misc_feature (928)..(928): location 928 can be absent or Glu
  Misc_feature (929)..(929): location 929 can be absent or Asp
  Misc_feature (930)..(930): location 930 can be absent or Gly
  Misc_feature (931)..(931): location 931 can be absent or Pro
  Misc_feature (932)..(932): location 932 can be absent or Pro
  Misc_feature (933)..(933): location 933 can be absent or Ile
  Misc_feature (934)..(934): location 934 can be absent or Arg
  Misc_feature (935)..(935): location 935 can be absent or Ser
  Misc_feature (936)..(936): location 936 can be absent or Lys
  Misc_feature (937)..(937): location 937 can be absent or Arg
  Misc_feature (938)..(938): location 938 can be absent or Arg
  Misc_feature (939)..(939): location 939 can be absent or Leu
  Misc_feature (940)..(940): location 940 can be absent or Ile
  Misc_feature (941)..(941): location 941 can be absent or Tyr
  Misc_feature (942)..(942): location 942 can be absent or Thr
  Misc_feature (943)..(943): location 943 can be absent or Thr
  Misc_feature (944)..(944): location 944 can be absent or Gln
  Misc_feature (945)..(945): location 945 can be absent or Leu
  Misc_feature (946)..(946): location 946 can be absent or Met
  Misc_feature (947)..(947): location 947 can be absent or Gln
  Misc_feature (948)..(948): location 948 can be absent or Gln
  Misc_feature (949)..(949): location 949 can be absent or Leu
  Misc_feature (950)..(950): location 950 can be absent or Phe
  Misc_feature (951)..(951): location 951 can be absent or Arg
  Misc_feature (952)..(952): location 952 can be absent or Pro
  Misc_feature (953)..(953): location 953 can be absent or Leu
  Misc_feature (954)..(954): location 954 can be absent or Pro
  Misc_feature (955)..(955): location 955 can be absent or Gly
  Misc_feature (956)..(956): location 956 can be absent or Arg
  Misc_feature (957)..(957): location 957 can be absent or Val
  Misc_feature (958)..(958): location 958 can be absent or Lys
  Misc_feature (959)..(959): location 959 can be absent or Ser
  Misc_feature (960)..(960): location 960 can be absent or Leu
  Misc_feature (961)..(961): location 961 can be absent or Val
  Misc_feature (962)..(962): location 962 can be absent or Thr
  Misc_feature (963)..(963): location 963 can be absent or Ser
  Misc_feature (964)..(964): location 964 can be absent or Tyr
  Misc_feature (965)..(965): location 965 can be absent or Glu
  Misc_feature (966)..(966): location 966 can be absent or Phe
  Misc_feature (967)..(967): location 967 can be absent or Val
  Misc_feature (968)..(968): location 968 can be absent or Ala
  Misc_feature (969)..(969): location 969 can be absent or Tyr
  Misc_feature (970)..(970): location 970 can be absent or Ser
  Misc_feature (971)..(971): location 971 can be absent or Ala
  Misc_feature (972)..(972): location 972 can be absent or Ala
  Misc_feature (973)..(973): location 973 can be absent or Arg
  Misc_feature (974)..(974): location 974 can be absent or Ala
  Misc_feature (975)..(975): location 975 can be absent or Ala
  Misc_feature (976)..(976): location 976 can be absent or Leu
  Misc_feature (977)..(977): location 977 can be absent or Gly
  Misc_feature (978)..(978): location 978 can be absent or Asp
  Misc_feature (979)..(979): location 979 can be absent or Ala
  Misc_feature (980)..(980): location 980 can be absent or Cys
  Misc_feature (981)..(981): location 981 can be absent or Ser
  Misc_feature (982)..(982): location 982 can be absent or Ser
  Misc_feature (983)..(983): location 983 can be absent or Thr
  Misc_feature (984)..(984): location 984 can be absent or Ser
  Misc_feature (985)..(985): location 985 can be absent or Thr
  Misc_feature (986)..(986): location 986 can be absent or Asp
  Misc_feature (987)..(987): location 987 can be absent or Arg
  Misc_feature (988)..(988): location 988 can be absent or Ile
  Misc_feature (989)..(989): location 989 can be absent or Glu
  Misc_feature (990)..(990): location 990 can be absent or Gly
  Misc_feature (991)..(991): location 991 can be absent or Phe
  Misc_feature (992)..(992): location 992 can be absent or Leu
  Misc_feature (993)..(993): location 993 can be absent or Leu
  Misc_feature (994)..(994): location 994 can be absent or Gln
  Misc_feature (995)..(995): location 995 can be absent or Asn
  Misc_feature (996)..(996): location 996 can be absent or Asn
  Misc_feature (997)..(997): location 997 can be absent or Leu
  Misc_feature (998)..(998): location 998 can be absent or Asn
  Misc_feature (999)..(999): location 999 can be absent or Pro
  Misc_feature (1000)..(1000): location 1000 can be absent or Leu
  Misc_feature (1001)..(1001): location 1001 can be absent or Ser
  Misc_feature (1002)..(1002): location 1002 can be absent or Glu
  Misc_feature (1003)..(1003): location 1003 can be absent or Arg
  Misc_feature (1004)..(1004): location 1004 can be absent or Thr
  Misc_feature (1005)..(1005): location 1005 can be absent or Glu
  Misc_feature (1006)..(1006): location 1006 can be absent or Thr
  Misc_feature (1007)..(1007): location 1007 can be absent or Glu
  Misc_feature (1008)..(1008): location 1008 can be absent or Lys
  Misc_feature (1009)..(1009): location 1009 can be absent or Met
  Misc_feature (1010)..(1010): location 1010 can be absent or Ser
  Misc_feature (1011)..(1011): location 1011 can be absent or Asp
  Misc_feature (1012)..(1012): location 1012 can be absent or Gln
  Misc_feature (1013)..(1013): location 1013 can be absent or Tyr
  Misc_feature (1014)..(1014): location 1014 can be absent or Ile
  Misc_feature (1015)..(1015): location 1015 can be absent or Ser
  Misc_feature (1016)..(1016): location 1016 can be absent or Lys
  Misc_feature (1017)..(1017): location 1017 can be absent or Ala
  Misc_feature (1018)..(1018): location 1018 can be absent or Ala
  Misc_feature (1019)..(1019): location 1019 can be absent or Glu
  Misc_feature (1020)..(1020): location 1020 can be absent or Asp
  Misc_feature (1021)..(1021): location 1021 can be absent or Phe
  Misc_feature (1022)..(1022): location 1022 can be absent or Ile
  Misc_feature (1023)..(1023): location 1023 can be absent or Ser
  Misc_feature (1024)..(1024): location 1024 can be absent or Arg
  Misc_feature (1025)..(1025): location 1025 can be absent or Thr
  Misc_feature (1026)..(1026): location 1026 can be absent or Lys
  Misc_feature (1027)..(1027): location 1027 can be absent or Lys
  Misc_feature (1028)..(1028): location 1028 can be absent or Leu
  Misc_feature (1029)..(1029): location 1029 can be absent or Glu
  Misc_feature (1030)..(1030): location 1030 can be absent or Thr
  Misc_feature (1031)..(1031): location 1031 can be absent or Asp
  Misc_feature (1032)..(1032): location 1032 can be absent or Phe
  Misc_feature (1033)..(1033): location 1033 can be absent or Ala
  Misc_feature (1034)..(1034): location 1034 can be absent or Gly
  Misc_feature (1035)..(1035): location 1035 can be absent or Leu
  Misc_feature (1036)..(1036): location 1036 can be absent or Glu
  Misc_feature (1037)..(1037): location 1037 can be absent or Lys
  Misc_feature (1038)..(1038): location 1038 can be absent or Gly
  Misc_feature (1039)..(1039): location 1039 can be absent or Thr
  Misc_feature (1040)..(1040): location 1040 can be absent or Thr
  Misc_feature (1041)..(1041): location 1041 can be absent or Ile
  Misc_feature (1042)..(1042): location 1042 can be absent or Thr
  Misc_feature (1043)..(1043): location 1043 can be absent or Asp
  Misc_feature (1044)..(1044): location 1044 can be absent or Leu
  Misc_feature (1045)..(1045): location 1045 can be absent or Arg
  Misc_feature (1046)..(1046): location 1046 can be absent or Val
  Misc_feature (1047)..(1047): location 1047 can be absent or Glu
  Misc_feature (1048)..(1048): location 1048 can be absent or Val
  Misc_feature (1049)..(1049): location 1049 can be absent or Gln
  Misc_feature (1050)..(1050): location 1050 can be absent or Asp
  Misc_feature (1051)..(1051): location 1051 can be absent or Leu
  Misc_feature (1052)..(1052): location 1052 can be absent or Glu
  Misc_feature (1053)..(1053): location 1053 can be absent or Arg
  Misc_feature (1054)..(1054): location 1054 can be absent or Phe
  Misc_feature (1055)..(1055): location 1055 can be absent or Ala
  Misc_feature (1056)..(1056): location 1056 can be absent or Val
  Misc_feature (1057)..(1057): location 1057 can be absent or Ile
  Misc_feature (1058)..(1058): location 1058 can be absent or Asn
  Misc_feature (1059)..(1059): location 1059 can be absent or Arg
  Misc_feature (1060)..(1060): location 1060 can be absent or Phe
  Misc_feature (1061)..(1061): location 1061 can be absent or Ala
  Misc_feature (1062)..(1062): location 1062 can be absent or Ser
  Misc_feature (1063)..(1063): location 1063 can be absent or Phe
  Misc_feature (1064)..(1064): location 1064 can be absent or His
  Misc_feature (1065)..(1065): location 1065 can be absent or Gln
  Misc_feature (1066)..(1066): location 1066 can be absent or Ser
  Misc_feature (1067)..(1067): location 1067 can be absent or Ser
  Misc_feature (1068)..(1068): location 1068 can be absent or Ser
  Misc_feature (1069)..(1069): location 1069 can be absent or Ser
  Misc_feature (1070)..(1070): location 1070 can be absent or Met
  Misc_feature (1071)..(1071): location 1071 can be absent or Asp
  Misc_feature (1072)..(1072): location 1072 can be absent or Arg
  Misc_feature (1073)..(1073): location 1073 can be absent or Ser
  Misc_feature (1074)..(1074): location 1074 can be absent or Val
  Misc_feature (1075)..(1075): location 1075 can be absent or Ser
  Misc_feature (1076)..(1076): location 1076 can be absent or Ser
  Misc_feature (1077)..(1077): location 1077 can be absent or Leu
  Misc_feature (1078)..(1078): location 1078 can be absent or Arg
  Misc_feature (1079)..(1079): location 1079 can be absent or Leu
  Misc_feature (1080)..(1080): location 1080 can be absent or Asn
  Misc_feature (1081)..(1081): location 1081 can be absent or Pro
  Misc_feature (1082)..(1082): location 1082 can be absent or Gln
  Misc_feature (1083)..(1083): location 1083 can be absent or Arg
  Misc_feature (1084)..(1084): location 1084 can be absent or Tyr
  Misc_feature (1085)..(1085): location 1085 can be absent or Val
  Misc_feature (1086)..(1086): location 1086 can be absent or Thr
  Misc_feature (1087)..(1087): location 1087 can be absent or Val
  Misc_feature (1088)..(1088): location 1088 can be absent or Ala
  Misc_feature (1089)..(1089): location 1089 can be absent or Pro
  Misc_feature (1090)..(1090): location 1090 can be absent or Val
  Misc_feature (1091)..(1091): location 1091 can be absent or Pro
  Misc_feature (1092)..(1092): location 1092 can be absent or Arg
  Misc_feature (1093)..(1093): location 1093 can be absent or His
  Misc_feature (1094)..(1094): location 1094 can be absent or Ile
  Misc_feature (1095)..(1095): location 1095 can be absent or Pro
  Misc_feature (1096)..(1096): location 1096 can be absent or Asp
  Misc_feature (1097)..(1097): location 1097 can be absent or Arg
  Misc_feature (1098)..(1098): location 1098 can be absent or Cys
  Misc_feature (1099)..(1099): location 1099 can be absent or Cys
  Misc_feature (1100)..(1100): location 1100 can be absent or Lys
  Misc_feature (1101)..(1101): location 1101 can be absent or Lys
  Misc_feature (1102)..(1102): location 1102 can be absent or Gln
  Misc_feature (1103)..(1103): location 1103 can be absent or Gly
  Misc_feature (1104)..(1104): location 1104 can be absent or Pro
  Misc_feature (1105)..(1105): location 1105 can be absent or Lys
  Misc_feature (1106)..(1106): location 1106 can be absent or Ile
  Misc_feature (1107)..(1107): location 1107 can be absent or Arg
  Misc_feature (1108)..(1108): location 1108 can be absent or Glu
  Misc_feature (1109)..(1109): location 1109 can be absent or Ile
  Misc_feature (1110)..(1110): location 1110 can be absent or Lys
  Misc_feature (1111)..(1111): location 1111 can be absent or Arg
  Misc_feature (1112)..(1112): location 1112 can be absent or Glu
  Misc_feature (1113)..(1113): location 1113 can be absent or Lys
  Misc_feature (1114)..(1114): location 1114 can be absent or Val
  Misc_feature (1115)..(1115): location 1115 can be absent or Gly
  Misc_feature (1116)..(1116): location 1116 can be absent or Phe
  Misc_feature (1117)..(1117): location 1117 can be absent or His
  Misc_feature (1118)..(1118): location 1118 can be absent or Ile
  Misc_feature (1119)..(1119): location 1119 can be absent or Phe
  Misc_feature (1120)..(1120): location 1120 can be absent or Cys
  Misc_feature (1121)..(1121): location 1121 can be absent or Ile
  Misc_feature (1122)..(1122): location 1122 can be absent or Trp
  Misc_feature (1123)..(1123): location 1123 can be absent or Thr
  Misc_feature (1124)..(1124): location 1124 can be absent or Glu
  Misc_feature (1125)..(1125): location 1125 can be absent or Lys
  Misc_feature (1126)..(1126): location 1126 can be absent or Ser
  Misc_feature (1127)..(1127): location 1127 can be absent or Leu
  Misc_feature (1128)..(1128): location 1128 can be absent or Asn
  Misc_feature (1129)..(1129): location 1129 can be absent or Ser
  Misc_feature (1130)..(1130): location 1130 can be absent or Thr
  Misc_feature (1131)..(1131): location 1131 can be absent or Asn
  Misc_feature (1132)..(1132): location 1132 can be absent or Glu
  Misc_feature (1133)..(1133): location 1133 can be absent or Gln
  Misc_feature (1134)..(1134): location 1134 can be absent or Glu
  Misc_feature (1135)..(1135): location 1135 can be absent or Leu
  Misc_feature (1136)..(1136): location 1136 can be absent or Lys
  Misc_feature (1137)..(1137): location 1137 can be absent or Val
  Misc_feature (1138)..(1138): location 1138 can be absent or Leu
  Misc_feature (1139)..(1139): location 1139 can be absent or Val
  Misc_feature (1140)..(1140): location 1140 can be absent or Cys
  Misc_feature (1141)..(1141): location 1141 can be absent or Tyr
  Misc_feature (1142)..(1142): location 1142 can be absent or Ser
  Misc_feature (1143)..(1143): location 1143 can be absent or Arg
  Misc_feature (1144)..(1144): location 1144 can be absent or Ile
  Misc_feature (1145)..(1145): location 1145 can be absent or Arg
  Misc_feature (1146)..(1146): location 1146 can be absent or Glu
  Misc_feature (1147)..(1147): location 1147 can be absent or Ser
  Misc_feature (1148)..(1148): location 1148 can be absent or Lys
  Misc_feature (1149)..(1149): location 1149 can be absent or Thr
  Misc_feature (1150)..(1150): location 1150 can be absent or Gln
  Misc_feature (1151)..(1151): location 1151 can be absent or Arg
  Misc_feature (1152)..(1152): location 1152 can be absent or Gln
  Misc_feature (1153)..(1153): location 1153 can be absent or Thr
  Misc_feature (1154)..(1154): location 1154 can be absent or Thr
  Misc_feature (1155)..(1155): location 1155 can be absent or Ser
  Misc_feature (1156)..(1156): location 1156 can be absent or Asn
  Misc_feature (1157)..(1157): location 1157 can be absent or Leu
  Misc_feature (1158)..(1158): location 1158 can be absent or Trp
  Misc_feature (1159)..(1159): location 1159 can be absent or Cys
  Misc_feature (1160)..(1160): location 1160 can be absent or Gly
  Misc_feature (1161)..(1161): location 1161 can be absent or Asn
  Misc_feature (1162)..(1162): location 1162 can be absent or Lys
  Misc_feature (1163)..(1163): location 1163 can be absent or Ser
  Misc_feature (1164)..(1164): location 1164 can be absent or His
  Misc_feature (1165)..(1165): location 1165 can be absent or Thr
  Misc_feature (1166)..(1166): location 1166 can be absent or Arg
  Misc_feature (1167)..(1167): location 1167 can be absent or Ala
  Misc_feature (1168)..(1168): location 1168 can be absent or Thr
  Misc_feature (1169)..(1169): location 1169 can be absent or Ile
  Misc_feature (1170)..(1170): location 1170 can be absent or Arg
  Misc_feature (1171)..(1171): location 1171 can be absent or Arg
  Misc_feature (1172)..(1172): location 1172 can be absent or Gly
  Misc_feature (1173)..(1173): location 1173 can be absent or Glu
  Misc_feature (1174)..(1174): location 1174 can be absent or Met
  Misc_feature (1175)..(1175): location 1175 can be absent or Lys
  Misc_feature (1176)..(1176): location 1176 can be absent or Ile
  Misc_feature (1177)..(1177): location 1177 can be absent or Tyr
  Misc_feature (1178)..(1178): location 1178 can be absent or Pro
  Misc_feature (1179)..(1179): location 1179 can be absent or Glu
  Misc_feature (1180)..(1180): location 1180 can be absent or His
  Misc_feature (1181)..(1181): location 1181 can be absent or Asn
  Misc_feature (1182)..(1182): location 1182 can be absent or Ala
  Misc_feature (1183)..(1183): location 1183 can be absent or Gly
  Misc_feature (1184)..(1184): location 1184 can be absent or Asp
  Misc_feature (1185)..(1185): location 1185 can be absent or Ala
  Misc_feature (1186)..(1186): location 1186 can be absent or Glu
  Misc_feature (1187)..(1187): location 1187 can be absent or Asp
  Misc_feature (1188)..(1188): location 1188 can be absent or Asn
  Misc_feature (1189)..(1189): location 1189 can be absent or Gly
  Misc_feature (1190)..(1190): location 1190 can be absent or Asp
  Misc_feature (1191)..(1191): location 1191 can be absent or Glu
  Misc_feature (1192)..(1192): location 1192 can be absent or Ser
  Misc_feature (1193)..(1193): location 1193 can be absent or Gly
  Misc_feature (1194)..(1194): location 1194 can be absent or Val
  Misc_feature (1195)..(1195): location 1195 can be absent or Val
  Misc_feature (1196)..(1196): location 1196 can be absent or Asn
  Misc_feature (1197)..(1197): location 1197 can be absent or Gly
  Misc_feature (1198)..(1198): location 1198 can be absent or Lys
  Misc_feature (1199)..(1199): location 1199 can be absent or Ile
  Misc_feature (1200)..(1200): location 1200 can be absent or Leu
  Misc_feature (1201)..(1201): location 1201 can be absent or Arg
  Misc_feature (1202)..(1202): location 1202 can be absent or Arg
  Misc_feature (1203)..(1203): location 1203 can be absent or Tyr
  Misc_feature (1204)..(1204): location 1204 can be absent or Arg
  Misc_feature (1205)..(1205): location 1205 can be absent or Pro
  Misc_feature (1206)..(1206): location 1206 can be absent or Trp
  Misc_feature (1207)..(1207): location 1207 can be absent or Asn
  Misc_feature (1208)..(1208): location 1208 can be absent or Val
  Misc_feature (1209)..(1209): location 1209 can be absent or Arg
  Misc_feature (1210)..(1210): location 1210 can be absent or Leu
  Misc_feature (1211)..(1211): location 1211 can be absent or Cys
  Misc_feature (1212)..(1212): location 1212 can be absent or Arg
  Misc_feature (1213)..(1213): location 1213 can be absent or Arg
  Misc_feature (1214)..(1214): location 1214 can be absent or Arg
  Misc_feature (1215)..(1215): location 1215 can be absent or Leu
  Misc_feature (1216)..(1216): location 1216 can be absent or Pro
  Misc_feature (1217)..(1217): location 1217 can be absent or Trp
  Misc_feature (1218)..(1218): location 1218 can be absent or Ile
  Misc_feature (1219)..(1219): location 1219 can be absent or Val
  Misc_feature (1220)..(1220): location 1220 can be absent or His
  Misc_feature (1221)..(1221): location 1221 can be absent or Arg
  Misc_feature (1222)..(1222): location 1222 can be absent or Arg
  Misc_feature (1223)..(1223): location 1223 can be absent or Ser or Met
  Misc_feature (1224)..(1224): location 1224 can be absent or Val or Ser
  Misc_feature (1225)..(1225): location 1225 can be absent or Ile or Pro
  Misc_feature (1226)..(1226): location 1226 can be absent or Val or Ser
  Misc_feature (1227)..(1227): location 1227 can be absent or Gln or Thr
  Misc_feature (1228)..(1228): location 1228 can be absent or Phe
  Misc_feature (1229)..(1229): location 1229 can be absent or Pro
  Misc_feature (1230)..(1230): location 1230 can be absent or Pro
  Misc_feature (1231)..(1231): location 1231 can be absent or Pro or Met
  Misc_feature (1232)..(1232): location 1232 can be absent or Glu or Ala
  Misc_feature (1233)..(1233): location 1233 can be absent or Ser or Met or Thr
  Misc_feature (1234)..(1234): location 1234 can be absent or Glu or Pro or Ser
  Misc_feature (1235)..(1235): location 1235 can be absent or Ala or Ser
  Misc_feature (1236)..(1236): location 1236 can be absent or Pro or Ala
  Misc_feature (1237)..(1237): location 1237 can be absent or Ala or Thr
  Misc_feature (1238)..(1238): location 1238 can be absent or Pro or Ser
  Misc_feature (1239)..(1239): location 1239 can be absent or Ser or Thr
  Misc_feature (1240)..(1240): location 1240 can be absent or Ser or Arg
  Misc_feature (1241)..(1241): location 1241 can be absent or Pro or Arg
  Misc_feature (1242)..(1242): location 1242 can be absent or Pro or Ser or Gly
  Misc_feature (1243)..(1243): location 1243 can be absent or Leu or His
  Misc_feature (1244)..(1244): location 1244 can be absent or Ala or Gln
  Misc_feature (1245)..(1245): location 1245 can be absent or Glu or Ala or Ser
  Misc_feature (1246)..(1246): location 1246 can be absent or Ala or Pro or Phe or Ser
  Misc_feature (1247)..(1247): location 1247 can be absent or Ser or Thr or Gly
  Misc_feature (1248)..(1248): location 1248 can be absent or Pro or Ser or Thr
  Misc_feature (1249)..(1249): location 1249 can be absent or Pro or Ser
  Misc_feature (1250)..(1250): location 1250 can be absent or Pro or Ser
  Misc_feature (1251)..(1251): location 1251 can be absent or Pro or Ser or Gly or Thr
  Misc_feature (1252)..(1252): location 1252 can be absent or Pro or Ser
  Misc_feature (1253)..(1253): location 1253 can be absent or Pro or Phe or Ser
  Misc_feature (1254)..(1254): location 1254 can be absent or Pro or Ser
  Misc_feature (1255)..(1255): location 1255 can be absent or Ala or Leu or Ser
  Misc_feature (1256)..(1256): location 1256 can be absent or Ser
  Misc_feature (1257)..(1257): location 1257 can be absent or Leu or Met
  Misc_feature (1258)..(1258): location 1258 can be absent or Arg
  Misc_feature (1259)..(1259): location 1259 can be absent or Leu or Gln
  Misc_feature (1260)..(1260): location 1260 can be absent or Trp
  Misc_feature (1261)..(1261): location 1261 can be absent or Arg
  Misc_feature (1262)..(1262): location 1262 can be absent or Pro
  Misc_feature (1263)..(1263): location 1263 can be absent or Ala
  Misc_feature (1264)..(1264): location 1264 can be absent or Ala
  Misc_feature (1265)..(1265): location 1265 can be absent or Gln
  Misc_feature (1266)..(1266): location 1266 can be absent or His or Arg
  Misc_feature (1267)..(1267): location 1267 can be Asn or absent
  Misc_feature (1268)..(1268): location 1268 can be absent or Leu or Met
  Misc_feature (1269)..(1269): location 1269 can be absent or Arg
  Misc_feature (1270)..(1270): location 1270 can be Asn or absent
  Misc_feature (1271)..(1271): location 1271 can be absent or Gln
  Misc_feature (1272)..(1272): location 1272 can be absent or Trp
  Misc_feature (1273)..(1273): location 1273 can be absent or Ser
  Misc_feature (1274)..(1274): location 1274 can be Asn or absent or His or Arg
  Misc_feature (1275)..(1275): location 1275 can be absent or Leu
  Misc_feature (1276)..(1276): location 1276 can be absent or Leu or Ser
  Misc_feature (1277)..(1277): location 1277 can be Asn or absent or Ala
  Misc_feature (1278)..(1278): location 1278 can be absent or Ala or Cys
  Misc_feature (1279)..(1279): location 1279 can be absent or Lys or Arg
  Misc_feature (1280)..(1280): location 1280 can be absent or Glu or Gln or Ala or Thr
  Misc_feature (1281)..(1281): location 1281 can be absent or Gln or Arg
  Misc_feature (1282)..(1282): location 1282 can be absent or Trp
  Misc_feature (1283)..(1283): location 1283 can be Ile or absent or Leu
  Misc_feature (1284)..(1284): location 1284 can be Val or absent or Asp or Ala
  Misc_feature (1285)..(1285): location 1285 can be absent or Ala
  Misc_feature (1286)..(1286): location 1286 can be Val or absent or Ala or Cys
  Misc_feature (1287)..(1287): location 1287 can be absent or Ala or Ser
  Misc_feature (1288)..(1288): location 1288 can be absent or Asp or Ala or Ser
  Misc_feature (1289)..(1289): location 1289 can be absent or Gly
  Misc_feature (1290)..(1290): location 1290 can be absent or Arg
  Misc_feature (1291)..(1291): location 1291 can be absent or Ala or Ser
  Misc_feature (1292)..(1292): location 1292 can be absent or His
  Misc_feature (1293)..(1293): location 1293 can be absent or Ala
  Misc_feature (1294)..(1294): location 1294 can be absent or Ala or Ser or Thr
  Misc_feature (1295)..(1295): location 1295 can be absent or Xaa or Leu or Ala
  Misc_feature (1296)..(1296): location 1296 can be absent or Leu
  Misc_feature (1297)..(1297): location 1297 can be absent or Val
  Misc_feature (1298)..(1298): location 1298 can be Asn or absent
  Misc_feature (1299)..(1299): location 1299 can be Val or absent or Ala or Ser
  Misc_feature (1300)..(1300): location 1300 can be absent or Tyr or His
  Misc_feature (1301)..(1301): location 1301 can be absent or Leu
  Misc_feature (1302)..(1302): location 1302 can be absent or Ser
  Misc_feature (1303)..(1303): location 1303 can be absent or Gln or Arg or Cys
  Misc_feature (1304)..(1304): location 1304 can be absent or Lys or Arg or Ser
  Misc_feature (1305)..(1305): location 1305 can be Asn or absent or Tyr
  Misc_feature (1306)..(1306): location 1306 can be absent or Met
  Misc_feature (1307)..(1307): location 1307 can be absent or Pro
  Misc_feature (1308)..(1308): location 1308 can be absent or Met or Thr or Gly
  Misc_feature (1309)..(1309): location 1309 can be absent or Met
  Misc_feature (1310)..(1310): location 1310 can be absent or Asp or Glu
  Misc_feature (1311)..(1311): location 1311 can be absent or Leu
  Misc_feature (1312)..(1312): location 1312 can be absent or Gly
  Misc_feature (1313)..(1313): location 1313 can be absent or Val
  Misc_feature (1314)..(1314): location 1314 can be absent or Leu
  Misc_feature (1315)..(1315): location 1315 can be absent or Lys or Ser
  Misc_feature (1316)..(1316): location 1316 can be absent or Asp
  Misc_feature (1317)..(1317): location 1317 can be Ile or absent or Met
  Misc_feature (1318)..(1318): location 1318 can be absent or Xaa or Pro or Phe
  Misc_feature (1319)..(1319): location 1319 can be absent or Asp or Arg or Gly
  Misc_feature (1320)..(1320): location 1320 can be Ile or absent
  Misc_feature (1321)..(1321): location 1321 can be absent or Asp or Arg
  Misc_feature (1322)..(1322): location 1322 can be absent or Lys or Asp or Glu
  Misc_feature (1323)..(1323): location 1323 can be absent or Lys or Arg
  Misc_feature (1324)..(1324): location 1324 can be absent or Ala
  Misc_feature (1325)..(1325): location 1325 can be Asn or absent or Leu or Ser
  Misc_feature (1326)..(1326): location 1326 can be absent or Lys or Ala or Ser or Gly
  Misc_feature (1327)..(1327): location 1327 can be absent or Lys
  Misc_feature (1328)..(1328): location 1328 can be absent or Leu
  Misc_feature (1329)..(1329): location 1329 can be absent or Xaa or Ala or Phe
  Misc_feature (1330)..(1330): location 1330 can be absent or Leu or Arg or Thr
  Misc_feature (1331)..(1331): location 1331 can be absent or Gln or Arg
  Misc_feature (1332)..(1332): location 1332 can be absent or Glu or Gln or Arg
  Misc_feature (1333)..(1333): location 1333 can be absent or Glu or Ser or Cys
  Misc_feature (1334)..(1334): location 1334 can be Asn or absent or Gln or Ser
  Misc_feature (1335)..(1335): location 1335 can be absent or Tyr or Ala or Cys
  Misc_feature (1336)..(1336): location 1336 can be absent or Gln or Ser or Arg
  Misc_feature (1337)..(1337): location 1337 can be Ile or absent or Glu or Ser or Gly
  Misc_feature (1338)..(1338): location 1338 can be absent or Lys or Met
  Misc_feature (1339)..(1339): location 1339 can be absent or Leu
  Misc_feature (1340)..(1340): location 1340 can be absent or Leu
  Misc_feature (1341)..(1341): location 1341 can be absent or Ser
  Misc_feature (1342)..(1342): location 1342 can be absent or Ala or Ser
  Misc_feature (1343)..(1343): location 1343 can be absent or Tyr
  Misc_feature (1344)..(1344): location 1344 can be absent or Lys or Arg
  Misc_feature (1345)..(1345): location 1345 can be Glu or Leu
  Misc_feature (1346)..(1346): location 1346 can be Gln or Met
  Misc_feature (1348)..(1348): location 1348 can be Ala or Leu or Arg or Gly or Cys
  Misc_feature (1349)..(1349): location 1349 can be Ile or Val or Gln or Ala
  Misc_feature (1350)..(1350): location 1350 can be Val or Leu or Met or Thr
  Misc_feature (1351)..(1351): location 1351 can be Val or Ala or Ser
  Misc_feature (1352)..(1352): location 1352 can be Tyr or Asp or Glu
  Misc_feature (1353)..(1353): location 1353 can be Leu or Met
  Misc_feature (1354)..(1354): location 1354 can be Ile or Val
  Misc_feature (1355)..(1355): location 1355 can be Asn or Lys or Glu or Arg
  Misc_feature (1356)..(1356): location 1356 can be Val or Ala
  Misc_feature (1358)..(1358): location 1358 can be Arg or His
  Misc_feature (1359)..(1359): location 1359 can be Ala or Ser
  Misc_feature (1360)..(1360): location 1360 can be Leu or Met
  Misc_feature (1361)..(1361): location 1361 can be Lys or Arg
  Misc_feature (1362)..(1362): location 1362 can be Arg or Cys
  Misc_feature (1363)..(1363): location 1363 can be Tyr or Phe
  Misc_feature (1364)..(1364): location 1364 can be Phe or Ser or Thr
  Misc_feature (1366)..(1366): location 1366 can be Val or Leu or Ala or Gly
  Misc_feature (1367)..(1367): location 1367 can be Ala or Ser
  Misc_feature (1368)..(1368): location 1368 can be Asn or Pro or Ala or Ser or Thr
  Misc_feature (1369)..(1369): location 1369 can be Asn or Gly
  Misc_feature (1370)..(1370): location 1370 can be absent or Ser or Cys
  Misc_feature (1371)..(1371): location 1371 can be Pro or Ser
  Misc_feature (1372)..(1372): location 1372 can be Ile or Leu
  Misc_feature (1373)..(1373): location 1373 can be Ile or Val or Leu or Thr
  Misc_feature (1374)..(1374): location 1374 can be Gln or His or Arg
  Misc_feature (1376)..(1376): location 1376 can be Ser or Thr
  Misc_feature (1377)..(1377): location 1377 can be Tyr or Asp or Glu or Gly
  Misc_feature (1378)..(1378): location 1378 can be Asn or Arg or Thr
  Misc_feature (1379)..(1379): location 1379 can be Lys or Gln or Ser
  Misc_feature (1380)..(1380): location 1380 can be Asp or Glu or Ala
  Misc_feature (1381)..(1381): location 1381 can be Asn or Asp
  Misc_feature (1382)..(1382): location 1382 can be Gln or Leu or Ser or Met
  Misc_feature (1383)..(1383): location 1383 can be Asn or Ser
  Misc_feature (1385)..(1385): location 1385 can be Ala or Leu or Ser
  Misc_feature (1388)..(1388): location 1388 can be Cys or Gly
  Misc_feature (1391)..(1391): location 1391 can be Ile or Ala or Ser
  Misc_feature (1393)..(1393): location 1393 can be Val or Ala or Phe
  Misc_feature (1394)..(1394): location 1394 can be Phe or His or Gly
  Misc_feature (1395)..(1395): location 1395 can be Asn or Lys or Arg or Thr
  Misc_feature (1396)..(1396): location 1396 can be Trp or Phe or Cys
  Misc_feature (1397)..(1397): location 1397 can be Tyr or Trp or Val or Phe or His
  Misc_feature (1398)..(1398): location 1398 can be Asn or Val or Ser
  Misc_feature (1399)..(1399): location 1399 can be Ile or Val or Glu or Met
  Misc_feature (1400)..(1400): location 1400 can be Leu or Met or Ser or Thr
  Misc_feature (1401)..(1401): location 1401 can be Ile or Glu or Ala or Ser
  Misc_feature (1402)..(1402): location 1402 can be Pro or Phe or His
  Misc_feature (1404)..(1404): location 1404 can be Asn or Lys or Ser
  Misc_feature (1405)..(1405): location 1405 can be Leu or Phe or Met
  Misc_feature (1407)..(1407): location 1407 can be Lys or Xaa or Glu or Gln
  Misc_feature (1408)..(1408): location 1408 can be absent or Glu
  Misc_feature (1409)..(1409): location 1409 can be absent or Leu
  Misc_feature (1410)..(1410): location 1410 can be absent or Val
  Misc_feature (1411)..(1411): location 1411 can be absent or Asp or Glu or Gln
  Misc_feature (1412)..(1412): location 1412 can be absent or Met
  Misc_feature (1414)..(1414): location 1414 can be Val or absent or Lys or Xaa or Ser
  Misc_feature (1415)..(1415): location 1415 can be Ile or Val or Met or Arg or Ser
  Misc_feature (1416)..(1416): location 1416 can be Glu or Ser
  Misc_feature (1417)..(1417): location 1417 can be Val or Glu or Leu or Gln
  Misc_feature (1418)..(1418): location 1418 can be Lys or Leu or Met or Cys
  Misc_feature (1419)..(1419): location 1419 can be Leu or Gln or Arg
  Misc_feature (1420)..(1420): location 1420 can be Lys or Leu
  Misc_feature (1421)..(1421): location 1421 can be absent or Lys or Xaa
  Misc_feature (1422)..(1422): location 1422 can be absent or Arg
  Misc_feature (1423)..(1423): location 1423 can be absent or Leu
  Misc_feature (1424)..(1424): location 1424 can be Ile or Leu or Arg
  Misc_feature (1425)..(1425): location 1425 can be Val or Leu
  Misc_feature (1427)..(1427): location 1427 can be Ile or Val or Asp or Glu
  Misc_feature (1428)..(1428): location 1428 can be Leu or Phe or Met
  Misc_feature (1429)..(1429): location 1429 can be Glu or Leu
  Misc_feature (1430)..(1430): location 1430 can be Leu or Phe or Ser
  Misc_feature (1431)..(1431): location 1431 can be Ile or Val or Met
  Misc_feature (1432)..(1432): location 1432 can be Asn or Ala or Ser or Thr
  Misc_feature (1433)..(1433): location 1433 can be Ile or Leu or Phe
  Misc_feature (1434)..(1434): location 1434 can be Lys or Xaa or Ser
  Misc_feature (1435)..(1435): location 1435 can be Tyr or Glu or Thr
  Misc_feature (1436)..(1436): location 1436 can be Asp or Glu or Gly
  Misc_feature (1437)..(1437): location 1437 can be Val or absent or Thr
  Misc_feature (1438)..(1438): location 1438 can be absent or Glu or Pro or Gln or Ser
  Misc_feature (1439)..(1439): location 1439 can be Gln or Leu or Ala or His
  Misc_feature (1440)..(1440): location 1440 can be Val or Asp or Pro or Gln
  Misc_feature (1441)..(1441): location 1441 can be Ile or Lys or Ala or Pro or Thr
  Misc_feature (1442)..(1442): location 1442 can be Asn or Gln or Ser
  Misc_feature (1443)..(1443): location 1443 can be Asn or Leu
  Misc_feature (1444)..(1444): location 1444 can be Asn or Glu or His or Ser
  Misc_feature (1446)..(1446): location 1446 can be Ser or Gly
  Misc_feature (1447)..(1447): location 1447 can be Asn or Asp or Thr
  Misc_feature (1448)..(1448): location 1448 can be Glu or Gln
  Misc_feature (1450)..(1450): location 1450 can be Tyr or Phe
  Misc_feature (1451)..(1451): location 1451 can be Asp or His
  Misc_feature (1452)..(1452): location 1452 can be absent or Asp or Gly
  Misc_feature (1453)..(1453): location 1453 can be absent or Glu
  Misc_feature (1454)..(1454): location 1454 can be absent or Phe or Ser
  Misc_feature (1455)..(1455): location 1455 can be Asn or absent or Lys or Asp
  Misc_feature (1456)..(1456): location 1456 can be absent or Asp or Lys or Glu or His
  Misc_feature (1457)..(1457): location 1457 can be absent or Leu or Phe
  Misc_feature (1458)..(1458): location 1458 can be absent or Gln or Arg or Thr
  Misc_feature (1459)..(1459): location 1459 can be absent or Asp or Lys or Ser or Arg
  Misc_feature (1460)..(1460): location 1460 can be Ile or absent or Cys
  Misc_feature (1461)..(1461): location 1461 can be Asn or absent or Ser or Gly
  Misc_feature (1462)..(1462): location 1462 can be absent or Leu
  Misc_feature (1463)..(1463): location 1463 can be Tyr or absent or Gln or Leu or Gly
  Misc_feature (1464)..(1464): location 1464 can be absent or Ser or Cys
  Misc_feature (1465)..(1465): location 1465 can be Val or absent or Met or Gly
  Misc_feature (1466)..(1466): location 1466 can be Val or absent or Asp or Glu
  Misc_feature (1467)..(1467): location 1467 can be Val or absent or Ala or Ser or Thr
  Misc_feature (1468)..(1468): location 1468 can be absent or Tyr or Ala or Phe or His
  Misc_feature (1469)..(1469): location 1469 can be absent or Lys or Ala or Pro or Ser or Gly
  Misc_feature (1470)..(1470): location 1470 can be absent or Pro or Leu
  Misc_feature (1471)..(1471): location 1471 can be Val or absent or Pro
  Misc_feature (1472)..(1472): location 1472 can be absent or Lys or Glu or Pro or Leu
  Misc_feature (1473)..(1473): location 1473 can be Asn or absent or Pro
  Misc_feature (1474)..(1474): location 1474 can be absent or Trp or Arg
  Misc_feature (1475)..(1475): location 1475 can be Val or absent or Lys or Leu or Ser or Cys
  Misc_feature (1476)..(1476): location 1476 can be absent or Lys or Ala or Arg
  Misc_feature (1477)..(1477): location 1477 can be Asp or Glu or Gly
  Misc_feature (1478)..(1478): location 1478 can be Tyr or Val or Arg or Gly
  Misc_feature (1479)..(1479): location 1479 can be Asn or Lys or Leu or Ser
  Misc_feature (1480)..(1480): location 1480 can be Ile or Lys or Gln or Ser or Gly
  Misc_feature (1481)..(1481): location 1481 can be Ala or Ser or Gly
  Misc_feature (1482)..(1482): location 1482 can be Ile or Trp or Gln or Ser or Arg
  Misc_feature (1483)..(1483): location 1483 can be Asp or Gln or Ser or Arg
  Misc_feature (1484)..(1484): location 1484 can be absent or Ala or Ser
  Misc_feature (1485)..(1485): location 1485 can be Ile or absent or Leu
  Misc_feature (1486)..(1486): location 1486 can be absent or Arg or Ser
  Misc_feature (1487)..(1487): location 1487 can be Pro or Phe or His
  Misc_feature (1488)..(1488): location 1488 can be Asp or Thr or Gly
  Misc_feature (1489)..(1489): location 1489 can be Asn or Gln or His
  Misc_feature (1490)..(1490): location 1490 can be Gln or Leu or Thr
  Misc_feature (1492)..(1492): location 1492 can be Asn or Leu or Ser or Thr
  Misc_feature (1493)..(1493): location 1493 can be Pro or Ala or His
  Misc_feature (1495)..(1495): location 1495 can be Ile or Val
  Misc_feature (1498)..(1498): location 1498 can be Ile or Val
  Misc_feature (1502)..(1502): location 1502 can be Ser or Thr
  Misc_feature (1504)..(1504): location 1504 can be Leu or His
  Misc_feature (1506)..(1506): location 1506 can be Asn or Glu
  Misc_feature (1507)..(1507): location 1507 can be Val or Met
  Misc_feature (1509)..(1509): location 1509 can be Ile or Met
  Misc_feature (1510)..(1510): location 1510 can be Asn or Asp or Lys or Ser
  Misc_feature (1511)..(1511): location 1511 can be Xaa or Leu or Arg or Thr
  Misc_feature (1512)..(1512): location 1512 can be absent or Pro or His or Ser
  Misc_feature (1513)..(1513): location 1513 can be Glu or Ser or Arg
  Misc_feature (1514)..(1514): location 1514 can be Ile or Val or Met
  Misc_feature (1515)..(1515): location 1515 can be Ile or Asp or Gly
  Misc_feature (1516)..(1516): location 1516 can be Glu or Ala
  Misc_feature (1517)..(1517): location 1517 can be Ile or Met
  Misc_feature (1518)..(1518): location 1518 can be Lys or Leu or Phe
  Misc_feature (1519)..(1519): location 1519 can be Glu or Ala or Phe
  Misc_feature (1520)..(1520): location 1520 can be Ile or Leu
  Misc_feature (1521)..(1521): location 1521 can be Val or Leu
  Misc_feature (1522)..(1522): location 1522 can be absent or Glu or Gly
  Misc_feature (1523)..(1523): location 1523 can be absent or Glu
  Misc_feature (1524)..(1524): location 1524 can be absent or Glu
  Misc_feature (1525)..(1525): location 1525 can be Ile or absent or Met
  Misc_feature (1526)..(1526): location 1526 can be absent or Lys or Gln or Arg
  Misc_feature (1527)..(1527): location 1527 can be Ile or absent or Val
  Misc_feature (1528)..(1528): location 1528 can be absent or Lys or Thr
  Misc_feature (1529)..(1529): location 1529 can be absent or Leu or Phe
  Misc_feature (1530)..(1530): location 1530 can be absent or Ser or Arg
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXSSSXRLWRPAAQRNXRNQWSXLSXXXXQWXXAXXXGRXHAXXLVNXXLSXXXMPXMXLGVLXDMXXIXXKAXXKLXXXXXXYXXXLLSXYKEMVXXXXXXVXASXSMRCFXKXXXXXXXXQFSXXXXXXNDXGDGGGXPVFXXXSVXXFEXXAXELVXMFXXEXXLKXXXXLLXXXXIXLXXXVXXXXXLXWXDELYDGEXXXLXXXXLXSXXXXXPXXXXXXXXXXXXXXXXXXNXPXXEVLQVYLTTWXAXXNIXXXRXDEIXXLVXEEXXXXXX

SEQ ID NO: 10032 - protein, 1440 aa, Artificial
  consensus for SEQ ID NO: 151 and its homologs
  Misc_feature (1)..(1): location 1 can be absent or Met
  Misc_feature (2)..(2): location 2 can be absent or Asp
  Misc_feature (3)..(3): location 3 can be absent or Ser
  Misc_feature (4)..(4): location 4 can be absent or Pro
  Misc_feature (5)..(5): location 5 can be absent or Pro
  Misc_feature (6)..(6): location 6 can be absent or Pro
  Misc_feature (7)..(7): location 7 can be absent or Pro
  Misc_feature (8)..(8): location 8 can be absent or Arg
  Misc_feature (9)..(9): location 9 can be absent or Glu
  Misc_feature (10)..(10): location 10 can be absent or Glu
  Misc_feature (11)..(11): location 11 can be absent or Val
  Misc_feature (12)..(12): location 12 can be absent or Val
  Misc_feature (13)..(13): location 13 can be absent or Val
  Misc_feature (14)..(14): location 14 can be absent or Phe
  Misc_feature (15)..(15): location 15 can be absent or Ala
  Misc_feature (16)..(16): location 16 can be absent or Val
  Misc_feature (17)..(17): location 17 can be absent or Asn
  Misc_feature (18)..(18): location 18 can be absent or Ser
  Misc_feature (19)..(19): location 19 can be absent or Glu
  Misc_feature (20)..(20): location 20 can be absent or Arg
  Misc_feature (21)..(21): location 21 can be absent or Phe or Met
  Misc_feature (22)..(22): location 22 can be absent or Glu or Met or Gly
  Misc_feature (23)..(23): location 23 can be absent or Leu or Ser or Gly
  Misc_feature (24)..(24): location 24 can be absent or Glu or Arg or Ser
  Misc_feature (25)..(25): location 25 can be absent or Glu or Ala or Arg
  Misc_feature (26)..(26): location 26 can be absent or Asp or Ala
  Misc_feature (27)..(27): location 27 can be absent or Ala or Met or Gly
  Misc_feature (28)..(28): location 28 can be absent or Ala or Gly
  Misc_feature (29)..(29): location 29 can be absent or Asp or Glu or Ala
  Misc_feature (30)..(30): location 30 can be absent or Ala or Pro or Arg
  Misc_feature (31)..(31): location 31 can be absent or Ala or Pro or Gly
  Misc_feature (32)..(32): location 32 can be absent or Val or Glu or Ala
  Misc_feature (33)..(33): location 33 can be absent or Val or Ser
  Misc_feature (34)..(34): location 34 can be absent or Val or Leu
  Misc_feature (35)..(35): location 35 can be absent or Ala or Leu or Thr
  Misc_feature (36)..(36): location 36 can be absent or Val or Glu
  Misc_feature (37)..(37): location 37 can be Asn or absent or Phe
  Misc_feature (38)..(38): location 38 can be absent or Leu or Gly
  Misc_feature (39)..(39): location 39 can be absent or Glu or Met or Arg
  Misc_feature (40)..(40): location 40 can be absent or Ser or Arg
  Misc_feature (41)..(41): location 41 can be absent or Tyr or Asp or Arg
  Misc_feature (42)..(42): location 42 can be absent or Glu or Cys or Thr
  Misc_feature (43)..(43): location 43 can be Asn or absent or Ala or Arg
  Misc_feature (44)..(44): location 44 can be absent or Val or Phe or Ser
  Misc_feature (45)..(45): location 45 can be absent or Thr or Gly
  Misc_feature (46)..(46): location 46 can be absent or Val or Gly
  Misc_feature (47)..(47): location 47 can be absent or Asp or Ala or Gly
  Misc_feature (48)..(48): location 48 can be absent or Lys or Glu or Pro
  Misc_feature (49)..(49): location 49 can be absent or Leu or Arg or Ser
  Misc_feature (50)..(50): location 50 can be absent or Met or Arg or Gly or Thr
  Misc_feature (51)..(51): location 51 can be absent or Pro or Cys or Thr
  Misc_feature (52)..(52): location 52 can be Asn or absent or Leu or Gly
  Misc_feature (53)..(53): location 53 can be absent or Glu or Ala or Leu
  Misc_feature (54)..(54): location 54 can be absent or Glu or Arg or Gly
  Misc_feature (55)..(55): location 55 can be absent or Lys or Ala or Phe
  Misc_feature (56)..(56): location 56 can be absent or Ala or Leu or Thr
  Misc_feature (57)..(57): location 57 can be absent or Asp or Arg or Thr
  Misc_feature (58)..(58): location 58 can be absent or Ala or Pro or Thr
  Misc_feature (59)..(59): location 59 can be absent or Pro or Gln or Arg
  Misc_feature (60)..(60): location 60 can be absent or Pro or Thr
  Misc_feature (61)..(61): location 61 can be Val or absent or Pro or Thr
  Misc_feature (62)..(62): location 62 can be absent or Val or Ala or Phe or Arg
  Misc_feature (63)..(63): location 63 can be absent or Ala or Leu or Arg
  Misc_feature (64)..(64): location 64 can be absent or Pro or Gly
  Misc_feature (65)..(65): location 65 can be absent or Pro or Ser
  Misc_feature (66)..(66): location 66 can be absent or Lys or Pro or Gly
  Misc_feature (67)..(67): location 67 can be absent or Leu or Arg or Gly
  Misc_feature (68)..(68): location 68 can be absent or Ala or Leu or Gly
  Misc_feature (69)..(69): location 69 can be absent or Leu or Phe or Cys
  Misc_feature (70)..(70): location 70 can be absent or Arg or Cys or Gly
  Misc_feature (71)..(71): location 71 can be absent or Glu or Phe or Cys
  Misc_feature (72)..(72): location 72 can be absent or Arg or Gly
  Misc_feature (73)..(73): location 73 can be absent or Gly
  Misc_feature (74)..(74): location 74 can be absent or Cys
  Misc_feature (75)..(75): location 75 can be absent or Gly
  Misc_feature (76)..(76): location 76 can be absent or Ala
  Misc_feature (77)..(77): location 77 can be absent or Cys
  Misc_feature (78)..(78): location 78 can be absent or Val or Ala
  Misc_feature (79)..(79): location 79 can be Ile or absent or Val
  Misc_feature (80)..(80): location 80 can be absent or Val or Leu
  Misc_feature (81)..(81): location 81 can be Ile or absent or Val
  Misc_feature (82)..(82): location 82 can be absent or Ala or Ser
  Misc_feature (83)..(83): location 83 can be absent or Lys or Ala
  Misc_feature (84)..(84): location 84 can be absent or Tyr
  Misc_feature (85)..(85): location 85 can be Asn or absent or Asp
  Misc_feature (86)..(86): location 86 can be absent or Pro or Ala
  Misc_feature (87)..(87): location 87 can be absent or Val or Lys or Glu or Ala
  Misc_feature (88)..(88): location 88 can be absent or Ala or Thr
  Misc_feature (89)..(89): location 89 can be absent or Asp
  Misc_feature (90)..(90): location 90 can be absent or Glu
  Misc_feature (91)..(91): location 91 can be absent or Val
  Misc_feature (92)..(92): location 92 can be absent or Ala or Thr
  Misc_feature (93)..(93): location 93 can be absent or Glu or Ser or His
  Misc_feature (94)..(94): location 94 can be absent or Ala or Phe
  Misc_feature (95)..(95): location 95 can be Asn or absent or Ala or Ser
  Misc_feature (96)..(96): location 96 can be absent or Val or Ala
  Misc_feature (97)..(97): location 97 can be absent or Ser
  Misc_feature (98)..(98): location 98 can be absent or Ser
  Misc_feature (99)..(99): location 99 can be absent or Cys
  Misc_feature (100)..(100): location 100 can be absent or Leu
  Misc_feature (101)..(101): location 101 can be absent or Thr
  Misc_feature (102)..(102): location 102 can be absent or Leu
  Misc_feature (103)..(103): location 103 can be absent or Ala or Leu
  Misc_feature (104)..(104): location 104 can be Tyr or absent or Arg or Gly
  Misc_feature (105)..(105): location 105 can be absent or Ser or Gly
  Misc_feature (106)..(106): location 106 can be Ile or absent or Leu
  Misc_feature (107)..(107): location 107 can be absent or His
  Misc_feature (108)..(108): location 108 can be absent or Phe or His
  Misc_feature (109)..(109): location 109 can be absent or Arg or Cys
  Misc_feature (110)..(110): location 110 can be absent or Ala or Ser
  Misc_feature (111)..(111): location 111 can be Ile or absent or Val
  Misc_feature (112)..(112): location 112 can be Ile or absent or Thr
  Misc_feature (113)..(113): location 113 can be absent or Thr
  Misc_feature (114)..(114): location 114 can be absent or Ser or Thr
  Misc_feature (115)..(115): location 115 can be absent or Glu
  Misc_feature (116)..(116): location 116 can be absent or Gly
  Misc_feature (117)..(117): location 117 can be Ile or absent or Leu
  Misc_feature (118)..(118): location 118 can be absent or Gly
  Misc_feature (119)..(119): location 119 can be Asn or absent or Ser
  Misc_feature (120)..(120): location 120 can be absent or Ser or Thr
  Misc_feature (121)..(121): location 121 can be absent or Lys or Arg
  Misc_feature (122)..(122): location 122 can be absent or Asp or Arg
  Misc_feature (123)..(123): location 123 can be absent or Gly
  Misc_feature (124)..(124): location 124 can be absent or Leu or Phe
  Misc_feature (125)..(125): location 125 can be absent or His
  Misc_feature (126)..(126): location 126 can be absent or Pro or Ala
  Misc_feature (127)..(127): location 127 can be Ile or absent or Val or Leu
  Misc_feature (128)..(128): location 128 can be absent or Gln or His
  Misc_feature (129)..(129): location 129 can be absent or Lys or Glu or Arg
  Misc_feature (130)..(130): location 130 can be absent or Arg
  Misc_feature (131)..(131): location 131 can be absent or Leu or Met
  Misc_feature (132)..(132): location 132 can be absent or Ala or Ser
  Misc_feature (133)..(133): location 133 can be absent or Gly
  Misc_feature (134)..(134): location 134 can be absent or Phe
  Misc_feature (135)..(135): location 135 can be absent or His
  Misc_feature (136)..(136): location 136 can be absent or Ala
  Misc_feature (137)..(137): location 137 can be absent or Ser
  Misc_feature (138)..(138): location 138 can be absent or Gln
  Misc_feature (139)..(139): location 139 can be absent or Cys
  Misc_feature (140)..(140): location 140 can be absent or Gly
  Misc_feature (141)..(141): location 141 can be absent or Phe
  Misc_feature (142)..(142): location 142 can be absent or Cys
  Misc_feature (143)..(143): location 143 can be absent or Thr
  Misc_feature (144)..(144): location 144 can be absent or Pro
  Misc_feature (145)..(145): location 145 can be absent or Gly
  Misc_feature (146)..(146): location 146 can be absent or Val or Met
  Misc_feature (147)..(147): location 147 can be absent or Cys
  Misc_feature (148)..(148): location 148 can be Val or absent or Met
  Misc_feature (149)..(149): location 149 can be absent or Ser
  Misc_feature (150)..(150): location 150 can be Ile or absent or Leu
  Misc_feature (151)..(151): location 151 can be absent or Tyr or Ala or Phe
  Misc_feature (152)..(152): location 152 can be absent or Ser or Gly
  Misc_feature (153)..(153): location 153 can be absent or Ala or Ser
  Misc_feature (154)..(154): location 154 can be absent or Leu
  Misc_feature (155)..(155): location 155 can be Val or absent or Ala
  Misc_feature (156)..(156): location 156 can be Asn or absent or Lys or Ala
  Misc_feature (157)..(157): location 157 can be absent or Ala
  Misc_feature (158)..(158): location 158 can be absent or Asp or Glu
  Misc_feature (159)..(159): location 159 can be absent or Lys or Arg
  Misc_feature (160)..(160): location 160 can be absent or Ala or Cys
  Misc_feature (161)..(161): location 161 can be absent or Ala or Ser
  Misc_feature (162)..(162): location 162 can be absent or Lys or Ser or Gly
  Misc_feature (163)..(163): location 163 can be Asn or absent or Ala or Ser or Arg
  Misc_feature (164)..(164): location 164 can be absent or Lys or Ala or Pro or Gly
  Misc_feature (165)..(165): location 165 can be absent or Lys or Ala or Pro or Ser
  Misc_feature (166)..(166): location 166 can be absent or Lys or Pro
  Misc_feature (167)..(167): location 167 can be absent or Asp or Ala or Pro
  Misc_feature (168)..(168): location 168 can be absent or Ala or Pro or Thr
  Misc_feature (169)..(169): location 169 can be absent or Pro or Ser
  Misc_feature (170)..(170): location 170 can be absent or Ala or Thr
  Misc_feature (171)..(171): location 171 can be absent or Pro or Ala
  Misc_feature (172)..(172): location 172 can be absent or Lys or Glu or Pro
  Misc_feature (173)..(173): location 173 can be absent or Gly
  Misc_feature (174)..(174): location 174 can be absent or Phe
  Misc_feature (175)..(175): location 175 can be absent or Ser
  Misc_feature (176)..(176): location 176 can be absent or Lys or Arg
  Misc_feature (177)..(177): location 177 can be Ile or absent or Leu
  Misc_feature (178)..(178): location 178 can be absent or Ser or Thr
  Misc_feature (179)..(179): location 179 can be Val or absent or Ala
  Misc_feature (180)..(180): location 180 can be absent or Ala or Ser
  Misc_feature (181)..(181): location 181 can be absent or Asp or Glu
  Misc_feature (182)..(182): location 182 can be absent or Ala
  Misc_feature (183)..(183): location 183 can be absent or Glu
  Misc_feature (184)..(184): location 184 can be absent or Lys or Arg
  Misc_feature (185)..(185): location 185 can be absent or Ala or Ser
  Misc_feature (186)..(186): location 186 can be absent or Val or Phe
  Misc_feature (187)..(187): location 187 can be absent or Ala or Ser
  Misc_feature (188)..(188): location 188 can be absent or Gly
  Misc_feature (189)..(189): location 189 can be Asn or absent
  Misc_feature (190)..(190): location 190 can be absent or Leu or Met
  Misc_feature (191)..(191): location 191 can be absent or Cys
  Misc_feature (192)..(192): location 192 can be absent or Arg
  Misc_feature (193)..(193): location 193 can be absent or Cys
  Misc_feature (194)..(194): location 194 can be absent or Thr
  Misc_feature (195)..(195): location 195 can be absent or Gly
  Misc_feature (196)..(196): location 196 can be absent or Tyr
  Misc_feature (197)..(197): location 197 can be absent or Arg
  Misc_feature (198)..(198): location 198 can be absent or Pro
  Misc_feature (199)..(199): location 199 can be Ile or absent
  Misc_feature (200)..(200): location 200 can be absent or Val or Leu or Ala
  Misc_feature (201)..(201): location 201 can be absent or Asp
  Misc_feature (202)..(202): location 202 can be absent or Ala
  Misc_feature (203)..(203): location 203 can be absent or Cys
  Misc_feature (204)..(204): location 204 can be absent or Lys
  Misc_feature (205)..(205): location 205 can be absent or Ser
  Misc_feature (206)..(206): location 206 can be absent or Phe
  Misc_feature (207)..(207): location 207 can be absent or Ala
  Misc_feature (208)..(208): location 208 can be absent or Ala or Ser
  Misc_feature (209)..(209): location 209 can be absent or Asp
  Misc_feature (210)..(210): location 210 can be absent or Val
  Misc_feature (211)..(211): location 211 can be absent or Asp
  Misc_feature (212)..(212): location 212 can be absent or Leu
  Misc_feature (213)..(213): location 213 can be absent or Glu
  Misc_feature (214)..(214): location 214 can be absent or Asp
  Misc_feature (215)..(215): location 215 can be absent or Leu
  Misc_feature (216)..(216): location 216 can be absent or Gly
  Misc_feature (217)..(217): location 217 can be absent or Leu
  Misc_feature (218)..(218): location 218 can be Asn or absent
  Misc_feature (219)..(219): location 219 can be Ile or absent or Ala or Ser or Cys
  Misc_feature (220)..(220): location 220 can be absent or Phe
  Misc_feature (221)..(221): location 221 can be absent or Trp
  Misc_feature (222)..(222): location 222 can be Asn or absent or Lys
  Misc_feature (223)..(223): location 223 can be absent or Lys
  Misc_feature (224)..(224): location 224 can be absent or Gly
  Misc_feature (225)..(225): location 225 can be Val or absent or Asp or Ala
  Misc_feature (226)..(226): location 226 can be absent or Lys or Asp or Ala
  Misc_feature (227)..(227): location 227 can be absent or Asp or His or Gly or Thr
  Misc_feature (228)..(228): location 228 can be absent or Glu or Pro or Ala
  Misc_feature (229)..(229): location 229 can be absent or Asp or His or Ser or Arg
  Misc_feature (230)..(230): location 230 can be absent or Val or Pro or Ala
  Misc_feature (231)..(231): location 231 can be absent or Asp or Ser or Thr
  Misc_feature (232)..(232): location 232 can be Ile or absent or Val or Lys
  Misc_feature (233)..(233): location 233 can be Asn or absent or Leu or Thr or Gly
  Misc_feature (234)..(234): location 234 can be absent or Lys or Pro
  Misc_feature (235)..(235): location 235 can be absent or Pro or Leu
  Misc_feature (236)..(236): location 236 can be absent or Tyr or Pro
  Misc_feature (237)..(237): location 237 can be absent or Lys or Ala
  Misc_feature (238)..(238): location 238 can be absent or Tyr or Glu or Ser
  Misc_feature (239)..(239): location 239 can be Tyr or absent or Arg or Ser
  Misc_feature (240)..(240): location 240 can be absent or Ser or Cys or Thr or Gly
  Misc_feature (241)..(241): location 241 can be Ile or absent or Leu or Thr or Gly
  Misc_feature (242)..(242): location 242 can be absent or Ala or Gly
  Misc_feature (243)..(243): location 243 can be absent or Asp or Ala or Gly
  Misc_feature (244)..(244): location 244 can be absent or Val or Phe or Gly
  Misc_feature (245)..(245): location 245 can be Ile or absent or Ala or Pro or Cys
  Misc_feature (246)..(246): location 246 can be absent or Glu or Cys or Thr
  Misc_feature (247)..(247): location 247 can be absent or Phe or Thr
  Misc_feature (248)..(248): location 248 can be absent or Leu or Pro or Phe
  Misc_feature (249)..(249): location 249 can be absent or Lys or Glu or Pro
  Misc_feature (250)..(250): location 250 can be absent or Asp or Phe
  Misc_feature (251)..(251): location 251 can be absent or Glu or Leu or Phe
  Misc_feature (252)..(252): location 252 can be Ile or absent or Lys or Leu
  Misc_feature (253)..(253): location 253 can be absent or Lys or Arg or Ser
  Misc_feature (254)..(254): location 254 can be absent or Glu or Ser
  Misc_feature (255)..(255): location 255 can be Ile or absent or Glu or Ser
  Misc_feature (256)..(256): location 256 can be Ile or absent or Leu or Arg
  Misc_feature (257)..(257): location 257 can be absent or Lys or Ser or Gly
  Misc_feature (258)..(258): location 258 can be Ile or absent or Ser
  Misc_feature (259)..(259): location 259 can be absent or Asp or Ser or Met or Gly
  Misc_feature (260)..(260): location 260 can be Ile or absent or His or Gly
  Misc_feature (261)..(261): location 261 can be absent or Asp or Gln or Ser
  Misc_feature (262)..(262): location 262 can be Ile or absent or Ala or Phe
  Misc_feature (263)..(263): location 263 can be Asn or absent or Ser
  Misc_feature (264)..(264): location 264 can be absent or Asp or Ser or Gly
  Misc_feature (265)..(265): location 265 can be absent or Asp or Ala or Gly
  Misc_feature (266)..(266): location 266 can be absent or Pro or Ala or Ser or Thr
  Misc_feature (267)..(267): location 267 can be Ile or absent or Ala or Pro or Ser or Met
  Misc_feature (268)..(268): location 268 can be absent or Val or Ala or Ser
  Misc_feature (269)..(269): location 269 can be absent or Val or Ala or Ser or Gly
  Misc_feature (270)..(270): location 270 can be Val or absent or Pro or Ala or Ser
  Misc_feature (271)..(271): location 271 can be absent or Val or Arg or Thr
  Misc_feature (272)..(272): location 272 can be absent or Glu or Ser or Gly or Thr
  Misc_feature (273)..(273): location 273 can be absent or Asp or Ser or Gly
  Misc_feature (274)..(274): location 274 can be absent or Trp or Asp or Gly
  Misc_feature (275)..(275): location 275 can be absent or Tyr or Cys or Gly
  Misc_feature (276)..(276): location 276 can be absent or Trp or Gln or Cys
  Misc_feature (277)..(277): location 277 can be absent or Pro or Phe
  Misc_feature (278)..(278): location 278 can be absent or Lys or His
  Misc_feature (279)..(279): location 279 can be Asn or absent or Pro
  Misc_feature (280)..(280): location 280 can be Ile or absent or Val or Lys or Arg
  Misc_feature (281)..(281): location 281 can be absent or Lys or Glu or Ser
  Misc_feature (282)..(282): location 282 can be Ile or absent or Val or Glu or Gln
  Misc_feature (283)..(283): location 283 can be absent or Tyr or Glu
  Misc_feature (284)..(284): location 284 can be absent or Tyr or Glu
  Misc_feature (285)..(285): location 285 can be absent or Lys or Phe
  Misc_feature (286)..(286): location 286 can be absent or Leu or His
  Misc_feature (287)..(287): location 287 can be Ile or Val or absent or Arg
  Misc_feature (288)..(288): location 288 can be Asn or absent or Leu or Gly
  Misc_feature (289)..(289): location 289 can be absent or Phe or Ser
  Misc_feature (290)..(290): location 290 can be absent or Asp or Glu or Leu
  Misc_feature (291)..(291): location 291 can be absent or Ser or Cys
  Misc_feature (292)..(292): location 292 can be Asn or absent or Ser or Gly
  Misc_feature (293)..(293): location 293 can be absent or Leu or Ser
  Misc_feature (294)..(294): location 294 can be absent or Phe or Ser
  Misc_feature (295)..(295): location 295 can be absent or Asp or Ser
  Misc_feature (296)..(296): location 296 can be absent or Lys or Glu
  Misc_feature (297)..(297): location 297 can be absent or Met or Ser or Arg
  Misc_feature (298)..(298): location 298 can be absent or Arg or Ser
  Misc_feature (299)..(299): location 299 can be absent or Val or Thr
  Misc_feature (300)..(300): location 300 can be absent or Lys
  Misc_feature (301)..(301): location 301 can be Ile or absent or Val
  Misc_feature (302)..(302): location 302 can be absent or Val
  Misc_feature (303)..(303): location 303 can be absent or Val or Ala
  Misc_feature (304)..(304): location 304 can be absent or Ser or Gly
  Misc_feature (305)..(305): location 305 can be Asn or absent
  Misc_feature (306)..(306): location 306 can be absent or Thr
  Misc_feature (307)..(307): location 307 can be absent or Ser or Gly
  Misc_feature (308)..(308): location 308 can be absent or Ser or Thr
  Misc_feature (309)..(309): location 309 can be absent or Gly
  Misc_feature (310)..(310): location 310 can be absent or Val
  Misc_feature (311)..(311): location 311 can be absent or Tyr
  Misc_feature (312)..(312): location 312 can be absent or Lys or Arg
  Misc_feature (313)..(313): location 313 can be absent or Asp
  Misc_feature (314)..(314): location 314 can be absent or Ala or Gln
  Misc_feature (315)..(315): location 315 can be absent or Asp or Glu
  Misc_feature (316)..(316): location 316 can be absent or Leu
  Misc_feature (317)..(317): location 317 can be absent or Tyr or His
  Misc_feature (318)..(318): location 318 can be absent or Asp
  Misc_feature (319)..(319): location 319 can be absent or Lys or Arg
  Misc_feature (320)..(320): location 320 can be absent or Tyr
  Misc_feature (321)..(321): location 321 can be Ile or absent
  Misc_feature (322)..(322): location 322 can be Asn or absent or Asp
  Misc_feature (323)..(323): location 323 can be Ile or absent or Leu
  Misc_feature (324)..(324): location 324 can be absent or Ala or Arg or Ser
  Misc_feature (325)..(325): location 325 can be absent or Ala or Gln or Gly
  Misc_feature (326)..(326): location 326 can be Ile or absent
  Misc_feature (327)..(327): location 327 can be absent or Pro or Leu
  Misc_feature (328)..(328): location 328 can be absent or Glu
  Misc_feature (329)..(329): location 329 can be absent or Leu
  Misc_feature (330)..(330): location 330 can be Asn or absent or Ser
  Misc_feature (331)..(331): location 331 can be absent or Ala or Ser
  Misc_feature (332)..(332): location 332 can be Ile or absent or Val
  Misc_feature (333)..(333): location 333 can be Asn or Val or absent or Ser
  Misc_feature (334)..(334): location 334 can be absent or Lys or Arg
  Misc_feature (335)..(335): location 335 can be absent or Lys or Asp or Ser
  Misc_feature (336)..(336): location 336 can be absent or Val or Asp or Ser
  Misc_feature (337)..(337): location 337 can be Asn or absent or Lys
  Misc_feature (338)..(338): location 338 can be absent or Gly
  Misc_feature (339)..(339): location 339 can be Ile or absent or Val
  Misc_feature (340)..(340): location 340 can be absent or Glu or Gly
  Misc_feature (341)..(341): location 341 can be Ile or absent
  Misc_feature (342)..(342): location 342 can be absent or Gly
  Misc_feature (343)..(343): location 343 can be absent or Ala
  Misc_feature (344)..(344): location 344 can be absent or Val or Ala
  Misc_feature (345)..(345): location 345 can be absent or Val or Met or Thr
  Misc_feature (346)..(346): location 346 can be absent or Ser
  Misc_feature (347)..(347): location 347 can be Ile or absent
  Misc_feature (348)..(348): location 348 can be absent or Ser
  Misc_feature (349)..(349): location 349 can be absent or Gln or Arg
  Misc_feature (350)..(350): location 350 can be absent or Val or Thr
  Misc_feature (351)..(351): location 351 can be absent or Ile
  Misc_feature (352)..(352): location 352 can be absent or Glu
  Misc_feature (353)..(353): location 353 can be absent or Ile
  Misc_feature (354)..(354): location 354 can be absent or Leu
  Misc_feature (355)..(355): location 355 can be Asn or absent or Lys or Gln or Arg
  Misc_feature (356)..(356): location 356 can be absent or Gln or Ala or Gly
  Misc_feature (357)..(357): location 357 can be Ile or absent or Glu
  Misc_feature (358)..(358): location 358 can be absent or Asp or Glu or Ser or Gly
  Misc_feature (359)..(359): location 359 can be Asn or Ile or absent or Glu
  Misc_feature (360)..(360): location 360 can be absent or Leu or Ser
  Misc_feature (361)..(361): location 361 can be absent or Tyr or Arg or Ser or Thr
  Misc_feature (362)..(362): location 362 can be absent or Lys or Asp or Ser
  Misc_feature (363)..(363): location 363 can be absent or Asp or Ser or Gly
  Misc_feature (364)..(364): location 364 can be absent or Pro or Gly
  Misc_feature (365)..(365): location 365 can be absent or Asn or Gly
  Misc_feature (366)..(366): location 366 can be absent or Asp or Gly
  Misc_feature (367)..(367): location 367 can be absent or Ala or Ser
  Misc_feature (368)..(368): location 368 can be absent or Val or Ala
  Misc_feature (369)..(369): location 369 can be absent or Val
  Misc_feature (370)..(370): location 370 can be absent or Phe
  Misc_feature (371)..(371): location 371 can be absent or Arg or Cys
  Misc_feature (372)..(372): location 372 can be absent or Lys
  Misc_feature (373)..(373): location 373 can be Ile or absent or Leu
  Misc_feature (374)..(374): location 374 can be absent or Ala
  Misc_feature (375)..(375): location 375 can be Tyr or absent or Asp or Glu
  Misc_feature (376)..(376): location 376 can be absent or His
  Misc_feature (377)..(377): location 377 can be absent or Leu or Met
  Misc_feature (378)..(378): location 378 can be absent or Glu or Ser or Gly
  Misc_feature (379)..(379): location 379 can be absent or Lys
  Misc_feature (380)..(380): location 380 can be absent or Val
  Misc_feature (381)..(381): location 381 can be absent or Ala
  Misc_feature (382)..(382): location 382 can be absent or Ser
  Misc_feature (383)..(383): location 383 can be absent or Pro or Gln or Ser
  Misc_feature (384)..(384): location 384 can be absent or Phe
  Misc_feature (385)..(385): location 385 can be absent or Val
  Misc_feature (386)..(386): location 386 can be absent or Gln or Arg
  Misc_feature (387)..(387): location 387 can be Asn or absent
  Misc_feature (388)..(388): location 388 can be absent or Met or Thr
  Misc_feature (389)..(389): location 389 can be absent or Ala
  Misc_feature (390)..(390): location 390 can be absent or Ala or Ser or Thr
  Misc_feature (391)..(391): location 391 can be Ile or absent or Leu
  Misc_feature (392)..(392): location 392 can be absent or Gly
  Misc_feature (393)..(393): location 393 can be absent or Gly
  Misc_feature (394)..(394): location 394 can be Asn or absent
  Misc_feature (395)..(395): location 395 can be Ile or absent or Leu
  Misc_feature (396)..(396): location 396 can be Ile or absent
  Misc_feature (397)..(397): location 397 can be absent or Leu or Met
  Misc_feature (398)..(398): location 398 can be absent or Ala
  Misc_feature (399)..(399): location 399 can be absent or Gln or His
  Misc_feature (400)..(400): location 400 can be absent or Lys or Arg
  Misc_feature (401)..(401): location 401 can be Tyr or absent or Asp or Leu or Met
  Misc_feature (402)..(402): location 402 can be absent or Glu or Pro or Ser
  Misc_feature (403)..(403): location 403 can be absent or Phe
  Misc_feature (404)..(404): location 404 can be absent or Ala or Pro or Ser or Arg
  Misc_feature (405)..(405): location 405 can be absent or Ser
  Misc_feature (406)..(406): location 406 can be absent or Asp
  Misc_feature (407)..(407): location 407 can be Ile or absent
  Misc_feature (408)..(408): location 408 can be absent or Ala
  Misc_feature (409)..(409): location 409 can be absent or Thr
  Misc_feature (410)..(410): location 410 can be Ile or absent or Val
  Misc_feature (411)..(411): location 411 can be absent or Leu
  Misc_feature (412)..(412): location 412 can be absent or Leu
  Misc_feature (413)..(413): location 413 can be absent or Ala or Gly
  Misc_feature (414)..(414): location 414 can be absent or Ala
  Misc_feature (415)..(415): location 415 can be absent or Ala or Gly
  Misc_feature (416)..(416): location 416 can be absent or Ala or Ser
  Misc_feature (417)..(417): location 417 can be absent or Ser or Thr
  Misc_feature (418)..(418): location 418 can be absent or Val or Leu
  Misc_feature (419)..(419): location 419 can be Asn or absent or Cys or Thr
  Misc_feature (420)..(420): location 420 can be Ile or absent or Leu
  Misc_feature (421)..(421): location 421 can be absent or Gln
  Misc_feature (422)..(422): location 422 can be absent or Val or Gln
  Misc_feature (423)..(423): location 423 can be Val or absent or Ala or Ser
  Misc_feature (424)..(424): location 424 can be absent or Ala or Ser
  Misc_feature (425)..(425): location 425 can be absent or Lys or Glu or Ser
  Misc_feature (426)..(426): location 426 can be absent or Lys or Arg or Thr
  Misc_feature (427)..(427): location 427 can be absent or Leu or Arg or Met
  Misc_feature (428)..(428): location 428 can be Asn or absent or His or Met
  Misc_feature (429)..(429): location 429 can be absent or Val or Cys
  Misc_feature (430)..(430): location 430 can be Ile or absent or Leu or Thr
  Misc_feature (431)..(431): location 431 can be absent or Leu or Thr
  Misc_feature (432)..(432): location 432 can be absent or Glu or Leu
  Misc_feature (433)..(433): location 433 can be absent or Glu or Gln or Arg
  Misc_feature (434)..(434): location 434 can be absent or Glu or Phe
  Misc_feature (435)..(435): location 435 can be absent or Leu or Phe
  Misc_feature (436)..(436): location 436 can be absent or Asp or Glu or Leu
  Misc_feature (437)..(437): location 437 can be absent or Lys or Gln or Met
  Misc_feature (438)..(438): location 438 can be absent or Pro or Ala or Gln
  Misc_feature (439)..(439): location 439 can be absent or Pro
  Misc_feature (440)..(440): location 440 can be absent or Leu or Pro or Cys
  Misc_feature (441)..(441): location 441 can be absent or Asp or Gly or Cys
  Misc_feature (442)..(442): location 442 can be absent or Asp or His or Cys
  Misc_feature (443)..(443): location 443 can be Asn or absent or Lys or Ser
  Misc_feature (444)..(444): location 444 can be absent or Arg or Thr
  Misc_feature (445)..(445): location 445 can be absent or Leu or Thr
  Misc_feature (446)..(446): location 446 can be absent or Leu
  Misc_feature (447)..(447): location 447 can be absent or Leu
  Misc_feature (448)..(448): location 448 can be Ile or absent or Val or Ser or Arg
  Misc_feature (449)..(449): location 449 can be Ile or absent or Ser
  Misc_feature (450)..(450): location 450 can be Ile or absent or Tyr or Phe
  Misc_feature (451)..(451): location 451 can be Ile or absent or Ser
  Misc_feature (452)..(452): location 452 can be absent or Pro
  Misc_feature (453)..(453): location 453 can be absent or His
  Misc_feature (454)..(454): location 454 can be absent or Trp or Cys
  Misc_feature (455)..(455): location 455 can be absent or Ala or Thr
  Misc_feature (456)..(456): location 456 can be absent or Pro or Ser
  Misc_feature (457)..(457): location 457 can be absent or Ser
  Misc_feature (458)..(458): location 458 can be absent or Gly
  Misc_feature (459)..(459): location 459 can be absent or Ile
  Misc_feature (460)..(460): location 460 can be absent or Ser
  Misc_feature (461)..(461): location 461 can be absent or Ser
  Misc_feature (462)..(462): location 462 can be absent or Ser
  Misc_feature (463)..(463): location 463 can be absent or Ser
  Misc_feature (464)..(464): location 464 can be absent or Glu
  Misc_feature (465)..(465): location 465 can be absent or Ser
  Misc_feature (466)..(466): location 466 can be absent or Val
  Misc_feature (467)..(467): location 467 can be absent or Asn
  Misc_feature (468)..(468): location 468 can be Ile or absent or Lys
  Misc_feature (469)..(469): location 469 can be absent or Pro or Thr
  Misc_feature (470)..(470): location 470 can be absent or Asp or Gly
  Misc_feature (471)..(471): location 471 can be absent or Trp or Asp or Cys
  Misc_feature (472)..(472): location 472 can be absent or Lys or Cys or Gly
  Misc_feature (473)..(473): location 473 can be absent or Lys or Pro or Ser
  Misc_feature (474)..(474): location 474 can be Tyr or absent or Asp or Glu or Ala
  Misc_feature (475)..(475): location 475 can be absent or Asp or His or Ser
  Misc_feature (476)..(476): location 476 can be absent or Ser or Thr or Gly
  Misc_feature (477)..(477): location 477 can be Ile or absent or Val or Leu
  Misc_feature (478)..(478): location 478 can be Val or absent or Leu or Thr
  Misc_feature (479)..(479): location 479 can be absent or Phe
  Misc_feature (480)..(480): location 480 can be absent or Glu or Gln
  Misc_feature (481)..(481): location 481 can be absent or Ser or Thr
  Misc_feature (482)..(482): location 482 can be absent or Tyr or Phe
  Misc_feature (483)..(483): location 483 can be absent or Arg
  Misc_feature (484)..(484): location 484 can be absent or Ala
  Misc_feature (485)..(485): location 485 can be absent or Ala or Ser
  Misc_feature (486)..(486): location 486 can be absent or Pro
  Misc_feature (487)..(487): location 487 can be absent or Arg
  Misc_feature (488)..(488): location 488 can be absent or Pro
  Misc_feature (489)..(489): location 489 can be Ile or absent or Leu or Phe
  Misc_feature (490)..(490): location 490 can be absent or Gly
  Misc_feature (491)..(491): location 491 can be Asn or absent
  Misc_feature (492)..(492): location 492 can be absent or Ala
  Misc_feature (493)..(493): location 493 can be absent or Val
  Misc_feature (494)..(494): location 494 can be absent or Ser
  Misc_feature (495)..(495): location 495 can be absent or Tyr
  Misc_feature (496)..(496): location 496 can be absent or Val or Leu
  Misc_feature (497)..(497): location 497 can be Asn or absent
  Misc_feature (498)..(498): location 498 can be absent or Ser
  Misc_feature (499)..(499): location 499 can be absent or Ala
  Misc_feature (500)..(500): location 500 can be absent or Phe
  Misc_feature (501)..(501): location 501 can be absent or Leu
  Misc_feature (502)..(502): location 502 can be absent or Ala or Gly
  Misc_feature (503)..(503): location 503 can be absent or Lys or His or Arg
  Misc_feature (504)..(504): location 504 can be Val or absent or Leu or Ser
  Misc_feature (505)..(505): location 505 can be absent or Ser
  Misc_feature (506)..(506): location 506 can be absent or Val or Leu or Ser
  Misc_feature (507)..(507): location 507 can be absent or Asp
  Misc_feature (508)..(508): location 508 can be absent or Lys or Glu or Ala or Gly
  Misc_feature (509)..(509): location 509 can be absent or Ala or Ser or Thr
  Misc_feature (510)..(510): location 510 can be absent or Ser
  Misc_feature (511)..(511): location 511 can be absent or Gly
  Misc_feature (512)..(512): location 512 can be Asn or absent or Asp or Ser
  Misc_feature (513)..(513): location 513 can be Asn or absent or His or Cys
  Misc_feature (514)..(514): location 514 can be Ile or absent or Leu
  Misc_feature (515)..(515): location 515 can be Ile or absent or Leu
  Misc_feature (516)..(516): location 516 can be absent or Glu or Ser
  Misc_feature (517)..(517): location 517 can be Asn or absent or Lys or Asp
  Misc_feature (518)..(518): location 518 can be absent or Val or Leu
  Misc_feature (519)..(519): location 519 can be absent or Arg or His or Cys
  Misc_feature (520)..(520): location 520 can be absent or Leu
  Misc_feature (521)..(521): location 521 can be absent or Ala
  Misc_feature (522)..(522): location 522 can be absent or Phe
  Misc_feature (523)..(523): location 523 can be absent or Gly
  Misc_feature (524)..(524): location 524 can be absent or Pro or Ala
  Misc_feature (525)..(525): location 525 can be absent or Tyr or Phe
  Misc_feature (526)..(526): location 526 can be absent or Gly
  Misc_feature (527)..(527): location 527 can be absent or Ala or Ser or Thr
  Misc_feature (528)..(528): location 528 can be absent or Lys or Glu or Gln
  Misc_feature (529)..(529): location 529 can be absent or His
  Misc_feature (530)..(530): location 530 can be absent or Ala
  Misc_feature (531)..(531): location 531 can be Ile or absent or Val
  Misc_feature (532)..(532): location 532 can be absent or Arg
  Misc_feature (533)..(533): location 533 can be absent or Ala
  Misc_feature (534)..(534): location 534 can be absent or Ser or Arg or Thr
  Misc_feature (535)..(535): location 535 can be Asn or absent or Lys or Glu
  Misc_feature (536)..(536): location 536 can be absent or Val
  Misc_feature (537)..(537): location 537 can be absent or Glu
  Misc_feature (538)..(538): location 538 can be absent or Lys or Glu or Ser
  Misc_feature (539)..(539): location 539 can be Tyr or absent or Leu or Phe
  Misc_feature (540)..(540): location 540 can be absent or Leu
  Misc_feature (541)..(541): location 541 can be absent or Val or Lys or Thr
  Misc_feature (542)..(542): location 542 can be absent or Gly
  Misc_feature (543)..(543): location 543 can be absent or Lys
  Misc_feature (544)..(544): location 544 can be Ile or absent or Pro or Leu
  Misc_feature (545)..(545): location 545 can be Ile or absent or Val or Leu
  Misc_feature (546)..(546): location 546 can be absent or Ser or Thr
  Misc_feature (547)..(547): location 547 can be absent or Ala
  Misc_feature (548)..(548): location 548 can be absent or Pro or Ser
  Misc_feature (549)..(549): location 549 can be absent or Val or Leu
  Misc_feature (550)..(550): location 550 can be Ile or Val or absent or Leu
  Misc_feature (551)..(551): location 551 can be absent or Leu
  Misc_feature (552)..(552): location 552 can be absent or Glu
  Misc_feature (553)..(553): location 553 can be absent or Ala
  Misc_feature (554)..(554): location 554 can be Ile or absent or Val or Cys
  Misc_feature (555)..(555): location 555 can be absent or Arg or Thr
  Misc_feature (556)..(556): location 556 can be absent or Val or Leu
  Misc_feature (557)..(557): location 557 can be absent or Leu
  Misc_feature (558)..(558): location 558 can be absent or Lys or Arg
  Misc_feature (559)..(559): location 559 can be absent or Lys or Glu or Gly
  Misc_feature (560)..(560): location 560 can be absent or Val or Thr
  Misc_feature (561)..(561): location 561 can be Ile or absent or Val
  Misc_feature (562)..(562): location 562 can be absent or Val or Ser
  Misc_feature (563)..(563): location 563 can be absent or Pro
  Misc_feature (564)..(564): location 564 can be Val or absent or Ala or Gly
  Misc_feature (565)..(565): location 565 can be absent or Glu
  Misc_feature (566)..(566): location 566 can be absent or Gly
  Misc_feature (567)..(567): location 567 can be absent or Thr
  Misc_feature (568)..(568): location 568 can be absent or Arg or Thr
  Misc_feature (569)..(569): location 569 can be absent or His
  Misc_feature (570)..(570): location 570 can be absent or Ala or Pro
  Misc_feature (571)..(571): location 571 can be absent or Glu or Ala
  Misc_feature (572)..(572): location 572 can be absent or Tyr
  Misc_feature (573)..(573): location 573 can be absent or Arg
  Misc_feature (574)..(574): location 574 can be absent or Val or Ser
  Misc_feature (575)..(575): location 575 can be absent or Ser
  Misc_feature (576)..(576): location 576 can be Val or absent or Leu
  Misc_feature (577)..(577): location 577 can be absent or Ala
  Misc_feature (578)..(578): location 578 can be absent or Val
  Misc_feature (579)..(579): location 579 can be absent or Ala or Ser or Gly
  Misc_feature (580)..(580): location 580 can be absent or Tyr or Phe
  Misc_feature (581)..(581): location 581 can be absent or Leu
  Misc_feature (582)..(582): location 582 can be absent or Phe
  Misc_feature (583)..(583): location 583 can be absent or Lys or Ser or Arg
  Misc_feature (584)..(584): location 584 can be absent or Phe
  Misc_feature (585)..(585): location 585 can be absent or Leu
  Misc_feature (586)..(586): location 586 can be absent or Tyr or Ser or Thr
  Misc_feature (587)..(587): location 587 can be absent or Pro or Ser
  Misc_feature (588)..(588): location 588 can be Ile or absent or Leu
  Misc_feature (589)..(589): location 589 can be absent or Ala or Cys or Thr
  Misc_feature (590)..(590): location 590 can be Asn or absent or Lys
  Misc_feature (591)..(591): location 591 can be absent or Gly
  Misc_feature (592)..(592): location 592 can be absent or Val or Thr
  Misc_feature (593)..(593): location 593 can be absent or Ile or Phe
  Misc_feature (594)..(594): location 594 can be absent or Lys or Glu
  Misc_feature (595)..(595): location 595 can be absent or Pro
  Misc_feature (596)..(596): location 596 can be absent or Val or Gly
  Misc_feature (597)..(597): location 597 can be absent or Lys or Glu
  Misc_feature (598)..(598): location 598 can be absent or Ala or Thr
  Misc_feature (599)..(599): location 599 can be absent or Val or Leu
  Misc_feature (600)..(600): location 600 can be absent or Ser or His
  Misc_feature (601)..(601): location 601 can be absent or Ile or Leu
  Misc_feature (602)..(602): location 602 can be absent or Asn or Ser
  Misc_feature (603)..(603): location 603 can be absent or Glu or Gly
  Misc_feature (604)..(604): location 604 can be absent or Asp or Leu or His
  Misc_feature (605)..(605): location 605 can be Ile or absent or Asp or Leu
  Misc_feature (606)..(606): location 606 can be Ile or Val or absent or Asp or Glu
  Misc_feature (607)..(607): location 607 can be absent or Lys or Pro or His or Ser
  Misc_feature (608)..(608): location 608 can be absent or Asp or Glu or Pro or Thr
  Misc_feature (609)..(609): location 609 can be Asn or absent or Asp or Glu
  Misc_feature (610)..(610): location 610 can be Asn or absent or Ala
  Misc_feature (611)..(611): location 611 can be Asn or Val or absent or Gly
  Misc_feature (612)..(612): location 612 can be Asn or absent or Val or His
  Misc_feature (613)..(613): location 613 can be Asn or absent or Pro or Met
  Misc_feature (614)..(614): location 614 can be Asn or absent or Ala
  Misc_feature (615)..(615): location 615 can be Asn or absent or Arg or Gly
  Misc_feature (616)..(616): location 616 can be Asn or absent or Ser or Gly
  Misc_feature (617)..(617): location 617 can be Val or absent or Pro or Phe or Cys
  Misc_feature (618)..(618): location 618 can be absent or Asp or Pro or Thr
  Misc_feature (619)..(619): location 619 can be Asn or absent or Thr
  Misc_feature (620)..(620): location 620 can be absent or His or Gly
  Misc_feature (621)..(621): location 621 can be absent or Val or Ser or Thr
  Misc_feature (622)..(622): location 622 can be absent or Asp or Ala or Cys
  Misc_feature (623)..(623): location 623 can be Asn or absent or Val or Thr
  Misc_feature (624)..(624): location 624 can be absent or Ser or Thr or Gly
  Misc_feature (625)..(625): location 625 can be Ile or Asn or absent or Pro or Ser
  Misc_feature (626)..(626): location 626 can be Val or absent or Lys or Ala or Gly
  Misc_feature (627)..(627): location 627 can be Asn or absent or Asp or Glu or Thr
  Misc_feature (628)..(628): location 628 can be Ile or absent or Ser or Thr
  Misc_feature (629)..(629): location 629 can be Asn or absent or Ser
  Misc_feature (630)..(630): location 630 can be Asn or absent or Pro or Gly
  Misc_feature (631)..(631): location 631 can be absent or Val or Glu or Ser
  Misc_feature (632)..(632): location 632 can be absent or Lys or Ala
  Misc_feature (633)..(633): location 633 can be absent or Glu or Ser or His
  Misc_feature (634)..(634): location 634 can be absent or Asp or Ser
  Misc_feature (635)..(635): location 635 can be Asn or absent or Leu or Thr
  Misc_feature (636)..(636): location 636 can be absent or Val or His
  Misc_feature (637)..(637): location 637 can be absent or Asp or Gly
  Misc_feature (638)..(638): location 638 can be Asn or absent or Ser
  Misc_feature (639)..(639): location 639 can be absent or Asp or Phe or Ser
  Misc_feature (640)..(640): location 640 can be Tyr or absent or Asp or Arg
  Misc_feature (641)..(641): location 641 can be Ile or absent or Leu or Met
  Misc_feature (642)..(642): location 642 can be absent or Leu or Pro
  Misc_feature (643)..(643): location 643 can be Ile or absent or Glu or Leu
  Misc_feature (644)..(644): location 644 can be absent or Lys or Ser
  Misc_feature (645)..(645): location 645 can be absent or Ser
  Misc_feature (646)..(646): location 646 can be absent or Lys or Arg
  Misc_feature (647)..(647): location 647 can be absent or Gln or Arg
  Misc_feature (648)..(648): location 648 can be absent or Val or Glu
  Misc_feature (649)..(649): location 649 can be Ile or absent or Met or Thr
  Misc_feature (650)..(650): location 650 can be absent or Val or Glu or Leu
  Misc_feature (651)..(651): location 651 can be Ile or absent or Phe or Ser
  Misc_feature (652)..(652): location 652 can be absent or Ser or Gly
  Misc_feature (653)..(653): location 653 can be absent or Asp or Glu
  Misc_feature (654)..(654): location 654 can be absent or Asp or Glu
  Misc_feature (655)..(655): location 655 can be absent or Tyr
  Misc_feature (656)..(656): location 656 can be absent or Lys or Leu or Arg
  Misc_feature (657)..(657): location 657 can be absent or Pro
  Misc_feature (658)..(658): location 658 can be Ile or absent or Val
  Misc_feature (659)..(659): location 659 can be absent or Gly
  Misc_feature (660)..(660): location 660 can be absent or Asp or Lys or Leu
  Misc_feature (661)..(661): location 661 can be absent or Pro
  Misc_feature (662)..(662): location 662 can be Ile or absent or Ala
  Misc_feature (663)..(663): location 663 can be absent or Lys or Glu
  Misc_feature (664)..(664): location 664 can be absent or Lys
  Misc_feature (665)..(665): location 665 can be Tyr or absent or Val or Thr
  Misc_feature (666)..(666): location 666 can be absent or Lys or Gly
  Misc_feature (667)..(667): location 667 can be Val or absent or Ala
  Misc_feature (668)..(668): location 668 can be absent or Glu
  Misc_feature (669)..(669): location 669 can be absent or Leu
  Misc_feature (670)..(670): location 670 can be absent or Gln
  Misc_feature (671)..(671): location 671 can be absent or Ala
  Misc_feature (672)..(672): location 672 can be absent or Ser
  Misc_feature (673)..(673): location 673 can be absent or Gly
  Misc_feature (674)..(674): location 674 can be absent or Glu
  Misc_feature (675)..(675): location 675 can be absent or Ala
  Misc_feature (676)..(676): location 676 can be Ile or absent or Val
  Misc_feature (677)..(677): location 677 can be absent or Tyr
  Misc_feature (678)..(678): location 678 can be absent or Val
  Misc_feature (679)..(679): location 679 can be absent or Asp
  Misc_feature (680)..(680): location 680 can be absent or Asp
  Misc_feature (681)..(681): location 681 can be Ile or absent
  Misc_feature (682)..(682): location 682 can be absent or Pro or Ser
  Misc_feature (683)..(683): location 683 can be absent or Ala or Ser
  Misc_feature (684)..(684): location 684 can be absent or Pro
  Misc_feature (685)..(685): location 685 can be absent or Lys
  Misc_feature (686)..(686): location 686 can be Asn or absent or Asp
  Misc_feature (687)..(687): location 687 can be absent or Cys
  Misc_feature (688)..(688): location 688 can be absent or Leu
  Misc_feature (689)..(689): location 689 can be absent or Tyr or His
  Misc_feature (690)..(690): location 690 can be absent or Gly
  Misc_feature (691)..(691): location 691 can be absent or Glu or Ala
  Misc_feature (692)..(692): location 692 can be absent or Phe
  Misc_feature (693)..(693): location 693 can be Ile or absent or Val
  Misc_feature (694)..(694): location 694 can be absent or Tyr
  Misc_feature (695)..(695): location 695 can be absent or Ser
  Misc_feature (696)..(696): location 696 can be absent or Thr
  Misc_feature (697)..(697): location 697 can be absent or Lys or Gln or His
  Misc_feature (698)..(698): location 698 can be absent or Pro
  Misc_feature (699)..(699): location 699 can be absent or Leu or His
  Misc_feature (700)..(700): location 700 can be absent or Ala
  Misc_feature (701)..(701): location 701 can be Asn or absent or His
  Misc_feature (702)..(702): location 702 can be Ile or absent or Val
  Misc_feature (703)..(703): location 703 can be absent or Lys
  Misc_feature (704)..(704): location 704 can be absent or Asp or Ser or Gly
  Misc_feature (705)..(705): location 705 can be Ile or Val or absent
  Misc_feature (706)..(706): location 706 can be Asn or absent or Lys or Glu
  Misc_feature (707)..(707): location 707 can be absent or Leu or Phe
  Misc_feature (708)..(708): location 708 can be Asn or absent or Lys or Arg
  Misc_feature (709)..(709): location 709 can be absent or Pro or Ser
  Misc_feature (710)..(710): location 710 can be absent or Ser
  Misc_feature (711)..(711): location 711 can be absent or Leu
  Misc_feature (712)..(712): location 712 can be absent or Glu or Ala
  Misc_feature (713)..(713): location 713 can be absent or Gln or Ser
  Misc_feature (714)..(714): location 714 can be absent or Lys or Leu or Gln
  Misc_feature (715)..(715): location 715 can be absent or Lys
  Misc_feature (716)..(716): location 716 can be Ile or absent or Val or Thr
  Misc_feature (717)..(717): location 717 can be Ile or absent or Val or Leu
  Misc_feature (718)..(718): location 718 can be absent or Ala or Thr
  Misc_feature (719)..(719): location 719 can be Ile or absent or Val
  Misc_feature (720)..(720): location 720 can be Ile or absent or Val
  Misc_feature (721)..(721): location 721 can be absent or Ser or Thr
  Misc_feature (722)..(722): location 722 can be absent or Leu or Ala
  Misc_feature (723)..(723): location 723 can be absent or Lys
  Misc_feature (724)..(724): location 724 can be absent or Asp
  Misc_feature (725)..(725): location 725 can be Ile or absent
  Misc_feature (726)..(726): location 726 can be absent or Pro
  Misc_feature (727)..(727): location 727 can be absent or Lys or Thr
  Misc_feature (728)..(728): location 728 can be Asn or absent or Gly
  Misc_feature (729)..(729): location 729 can be absent or Gly
  Misc_feature (730)..(730): location 730 can be absent or Lys or Glu or Arg or Ser
  Misc_feature (731)..(731): location 731 can be Asn or absent
  Misc_feature (732)..(732): location 732 can be Ile or absent or Val
  Misc_feature (733)..(733): location 733 can be absent or Gly
  Misc_feature (734)..(734): location 734 can be absent or Ala or Ser
  Misc_feature (735)..(735): location 735 can be Asn or absent or Thr or Cys
  Misc_feature (736)..(736): location 736 can be absent or Phe or Ser or Thr
  Misc_feature (737)..(737): location 737 can be Ile or absent or Leu or Pro
  Misc_feature (738)..(738): location 738 can be absent or Phe or Met
  Misc_feature (739)..(739): location 739 can be absent or Leu or Gly
  Misc_feature (740)..(740): location 740 can be absent or Asp or Pro or Gly
  Misc_feature (741)..(741): location 741 can be absent or Asp or Glu
  Misc_feature (742)..(742): location 742 can be absent or Glu
  Misc_feature (743)..(743): location 743 can be absent or Pro or Ala
  Misc_feature (744)..(744): location 744 can be absent or Leu
  Misc_feature (745)..(745): location 745 can be absent or Phe
  Misc_feature (746)..(746): location 746 can be absent or Val or Ala or Gly
  Misc_feature (747)..(747): location 747 can be absent or Asp or His
  Misc_feature (748)..(748): location 748 can be absent or Pro
  Misc_feature (749)..(749): location 749 can be Ile or absent or Val or Leu
  Misc_feature (750)..(750): location 750 can be absent or Ala or Ser or Thr
  Misc_feature (751)..(751): location 751 can be absent or Glu or Gln
  Misc_feature (752)..(752): location 752 can be absent or Trp or Phe
  Misc_feature (753)..(753): location 753 can be absent or Ala
  Misc_feature (754)..(754): location 754 can be absent or Gly
  Misc_feature (755)..(755): location 755 can be absent or Glu or Gln
  Misc_feature (756)..(756): location 756 can be Asn or absent or Ala or Pro
  Misc_feature (757)..(757): location 757 can be Ile or absent or Leu
  Misc_feature (758)..(758): location 758 can be absent or Gly
  Misc_feature (759)..(759): location 759 can be Ile or absent or Val
  Misc_feature (760)..(760): location 760 can be absent or Val
  Misc_feature (761)..(761): location 761 can be Ile or absent or Val
  Misc_feature (762)..(762): location 762 can be absent or Ala
  Misc_feature (763)..(763): location 763 can be absent or Glu
  Misc_feature (764)..(764): location 764 can be absent or Thr
  Misc_feature (765)..(765): location 765 can be absent or Gln
  Misc_feature (766)..(766): location 766 can be absent or Lys or Arg
  Misc_feature (767)..(767): location 767 can be absent or Tyr or Thr
  Misc_feature (768)..(768): location 768 can be absent or Ala
  Misc_feature (769)..(769): location 769 can be Asn or absent or Tyr or Asp
  Misc_feature (770)..(770): location 770 can be Ile or absent or Met
  Misc_feature (771)..(771): location 771 can be absent or Ala
  Misc_feature (772)..(772): location 772 can be absent or Ala
  Misc_feature (773)..(773): location 773 can be absent or Lys or Arg or Ser
  Misc_feature (774)..(774): location 774 can be absent or Gln or Arg
  Misc_feature (775)..(775): location 775 can be absent or Ala or Ser
  Misc_feature (776)..(776): location 776 can be absent or Val or Leu
  Misc_feature (777)..(777): location 777 can be Ile or absent or Val
  Misc_feature (778)..(778): location 778 can be absent or Asp or Glu
  Misc_feature (779)..(779): location 779 can be absent or Tyr
  Misc_feature (780)..(780): location 780 can be Asn or absent or Ser or Thr
  Misc_feature (781)..(781): location 781 can be absent or Met or Thr
  Misc_feature (782)..(782): location 782 can be absent or Asp or Glu
  Misc_feature (783)..(783): location 783 can be Asn or absent or Gly
  Misc_feature (784)..(784): location 784 can be absent or Leu
  Misc_feature (785)..(785): location 785 can be absent or Lys or Asp or Gln
  Misc_feature (786)..(786): location 786 can be absent or Ala or Pro
  Misc_feature (787)..(787): location 787 can be absent or Pro
  Misc_feature (788)..(788): location 788 can be Ile or absent
  Misc_feature (789)..(789): location 789 can be absent or Leu
  Misc_feature (790)..(790): location 790 can be absent or Ser or Thr
  Misc_feature (791)..(791): location 791 can be Ile or Val or absent
  Misc_feature (792)..(792): location 792 can be absent or Glu
  Misc_feature (793)..(793): location 793 can be absent or Asp or Glu or Gln
  Misc_feature (794)..(794): location 794 can be absent or Ala
  Misc_feature (795)..(795): location 795 can be absent or Val
  Misc_feature (796)..(796): location 796 can be absent or Gln or Arg
  Misc_feature (797)..(797): location 797 can be Asn or absent or Ser or His
  Misc_feature (798)..(798): location 798 can be Asn or absent or Ser
  Misc_feature (799)..(799): location 799 can be absent or Ser
  Misc_feature (800)..(800): location 800 can be absent or Tyr
  Misc_feature (801)..(801): location 801 can be absent or Phe
  Misc_feature (802)..(802): location 802 can be absent or Glu or Gln or Pro
  Misc_feature (803)..(803): location 803 can be Ile or absent or Val
  Misc_feature (804)..(804): location 804 can be absent or Leu or Pro
  Misc_feature (805)..(805): location 805 can be absent or Pro
  Misc_feature (806)..(806): location 806 can be absent or Glu or Phe
  Misc_feature (807)..(807): location 807 can be absent or Leu or Arg
  Misc_feature (808)..(808): location 808 can be absent or Gln or Leu or Ala
  Misc_feature (809)..(809): location 809 can be absent or Pro
  Misc_feature (810)..(810): location 810 can be absent or Lys or Gln or Thr
  Misc_feature (811)..(811): location 811 can be absent or Lys or Gln or Pro
  Misc_feature (812)..(812): location 812 can be Ile or Val or absent
  Misc_feature (813)..(813): location 813 can be absent or Gly
  Misc_feature (814)..(814): location 814 can be absent or Asp or Glu
  Misc_feature (815)..(815): location 815 can be absent or Phe
  Misc_feature (816)..(816): location 816 can be Asn or absent or Ser
  Misc_feature (817)..(817): location 817 can be absent or Lys or Gln
  Misc_feature (818)..(818): location 818 can be absent or Ala or Gly
  Misc_feature (819)..(819): location 819 can be absent or Met
  Misc_feature (820)..(820): location 820 can be absent or Glu or Ala or Ser
  Misc_feature (821)..(821): location 821 can be absent or Glu
  Misc_feature (822)..(822): location 822 can be absent or Ala
  Misc_feature (823)..(823): location 823 can be absent or Asp
  Misc_feature (824)..(824): location 824 can be absent or Gln or His
  Misc_feature (825)..(825): location 825 can be absent or Lys
  Misc_feature (826)..(826): location 826 can be Ile or absent
  Misc_feature (827)..(827): location 827 can be Ile or absent or Tyr or Met
  Misc_feature (828)..(828): location 828 can be absent or Asp or Ser
  Misc_feature (829)..(829): location 829 can be absent or Glu or Thr or Gly
  Misc_feature (830)..(830): location 830 can be absent or Glu
  Misc_feature (831)..(831): location 831 can be absent or Val
  Misc_feature (832)..(832): location 832 can be Asn or absent or Lys
  Misc_feature (833)..(833): location 833 can be absent or Leu
  Misc_feature (834)..(834): location 834 can be absent or Glu or Ala or His or Gly
  Misc_feature (835)..(835): location 835 can be absent or Ser
  Misc_feature (836)..(836): location 836 can be absent or Gln
  Misc_feature (837)..(837): location 837 can be absent or Tyr
  Misc_feature (838)..(838): location 838 can be absent or Tyr
  Misc_feature (839)..(839): location 839 can be absent or Phe
  Misc_feature (840)..(840): location 840 can be absent or Tyr
  Misc_feature (841)..(841): location 841 can be absent or Met
  Misc_feature (842)..(842): location 842 can be absent or Glu
  Misc_feature (843)..(843): location 843 can be absent or Thr
  Misc_feature (844)..(844): location 844 can be absent or Gln
  Misc_feature (845)..(845): location 845 can be absent or Thr
  Misc_feature (846)..(846): location 846 can be absent or Ala
  Misc_feature (847)..(847): location 847 can be absent or Leu
  Misc_feature (848)..(848): location 848 can be absent or Ala
  Misc_feature (849)..(849): location 849 can be Ile or absent or Phe
  Misc_feature (850)..(850): location 850 can be absent or Pro
  Misc_feature (851)..(851): location 851 can be absent or Asp or Glu
  Misc_feature (852)..(852): location 852 can be absent or Glu
  Misc_feature (853)..(853): location 853 can be absent or Asp
  Misc_feature (854)..(854): location 854 can be Asn or absent
  Misc_feature (855)..(855): location 855 can be absent or Thr or Cys
  Misc_feature (856)..(856): location 856 can be Ile or absent or Met
  Misc_feature (857)..(857): location 857 can be absent or Val or Thr
  Misc_feature (858)..(858): location 858 can be absent or Val or Leu
  Misc_feature (859)..(859): location 859 can be absent or Tyr
  Misc_feature (860)..(860): location 860 can be absent or Val or Ser or Cys
  Misc_feature (861)..(861): location 861 can be absent or Ser
  Misc_feature (862)..(862): location 862 can be absent or Ala or Ser
  Misc_feature (863)..(863): location 863 can be absent or Gln
  Misc_feature (864)..(864): location 864 can be absent or Leu or Phe or Met or Cys
  Misc_feature (865)..(865): location 865 can be absent or Pro
  Misc_feature (866)..(866): location 866 can be absent or Glu
  Misc_feature (867)..(867): location 867 can be Ile or absent or Val or Leu
  Misc_feature (868)..(868): location 868 can be absent or Ala or Thr
  Misc_feature (869)..(869): location 869 can be absent or Gln
  Misc_feature (870)..(870): location 870 can be Asn or absent or Asp or Glu
  Misc_feature (871)..(871): location 871 can be Ile or Val or absent or Thr
  Misc_feature (872)..(872): location 872 can be Ile or absent or Val
  Misc_feature (873)..(873): location 873 can be absent or Ala or Ser
  Misc_feature (874)..(874): location 874 can be absent or Lys or Arg
  Misc_feature (875)..(875): location 875 can be absent or Cys
  Misc_feature (876)..(876): location 876 can be absent or Leu
  Misc_feature (877)..(877): location 877 can be absent or Gly
  Misc_feature (878)..(878): location 878 can be Ile or Val or absent or Leu
  Misc_feature (879)..(879): location 879 can be absent or Pro
  Misc_feature (880)..(880): location 880 can be absent or Tyr or Phe or Cys
  Misc_feature (881)..(881): location 881 can be Asn or absent or His
  Misc_feature (882)..(882): location 882 can be Asn or absent
  Misc_feature (883)..(883): location 883 can be absent or Val
  Misc_feature (884)..(884): location 884 can be absent or Arg
  Misc_feature (885)..(885): location 885 can be Ile or absent or Val
  Misc_feature (886)..(886): location 886 can be Ile or absent
  Misc_feature (887)..(887): location 887 can be absent or Thr
  Misc_feature (888)..(888): location 888 can be absent or Arg
  Misc_feature (889)..(889): location 889 can be absent or Arg
  Misc_feature (890)..(890): location 890 can be absent or Val or Ala
  Misc_feature (891)..(891): location 891 can be absent or Gly
  Misc_feature (892)..(892): location 892 can be absent or Gly
  Misc_feature (893)..(893): location 893 can be absent or Gly
  Misc_feature (894)..(894): location 894 can be absent or Phe
  Misc_feature (895)..(895): location 895 can be absent or Gly
  Misc_feature (896)..(896): location 896 can be absent or Gly
  Misc_feature (897)..(897): location 897 can be absent or Lys
  Misc_feature (898)..(898): location 898 can be absent or Ala
  Misc_feature (899)..(899): location 899 can be absent or Val or Met
  Misc_feature (900)..(900): location 900 can be absent or Lys or Arg
  Misc_feature (901)..(901): location 901 can be absent or Ala or Ser
  Misc_feature (902)..(902): location 902 can be Ile or absent or Leu or Thr
  Misc_feature (903)..(903): location 903 can be absent or Pro or His
  Misc_feature (904)..(904): location 904 can be Ile or absent or Val
  Misc_feature (905)..(905): location 905 can be absent or Ala
  Misc_feature (906)..(906): location 906 can be absent or Ala or Thr
  Misc_feature (907)..(907): location 907 can be absent or Ala
  Misc_feature (908)..(908): location 908 can be absent or Ala or Cys
  Misc_feature (909)..(909): location 909 can be absent or Ala
  Misc_feature (910)..(910): location 910 can be absent or Val or Leu
  Misc_feature (911)..(911): location 911 can be absent or Ala or Ser or Cys
  Misc_feature (912)..(912): location 912 can be absent or Ala
  Misc_feature (913)..(913): location 913 can be absent or Phe or His
  Misc_feature (914)..(914): location 914 can be absent or Lys or Thr
  Misc_feature (915)..(915): location 915 can be absent or Leu
  Misc_feature (916)..(916): location 916 can be absent or Gln or Arg
  Misc_feature (917)..(917): location 917 can be absent or Arg
  Misc_feature (918)..(918): location 918 can be absent or Pro
  Misc_feature (919)..(919): location 919 can be absent or Val
  Misc_feature (920)..(920): location 920 can be absent or Arg
  Misc_feature (921)..(921): location 921 can be Ile or absent or Met
  Misc_feature (922)..(922): location 922 can be absent or Tyr
  Misc_feature (923)..(923): location 923 can be absent or Leu
  Misc_feature (924)..(924): location 924 can be Asn or absent or Asp
  Misc_feature (925)..(925): location 925 can be absent or Arg
  Misc_feature (926)..(926): location 926 can be Asn or absent or Lys
  Misc_feature (927)..(927): location 927 can be absent or Thr
  Misc_feature (928)..(928): location 928 can be absent or Asp
  Misc_feature (929)..(929): location 929 can be absent or Met
  Misc_feature (930)..(930): location 930 can be Ile or absent
  Misc_feature (931)..(931): location 931 can be absent or Met
  Misc_feature (932)..(932): location 932 can be Val or absent or Ala or Thr
  Misc_feature (933)..(933): location 933 can be absent or Gly
  Misc_feature (934)..(934): location 934 can be absent or Gly
  Misc_feature (935)..(935): location 935 can be absent or Arg
  Misc_feature (936)..(936): location 936 can be absent or His
  Misc_feature (937)..(937): location 937 can be absent or Pro
  Misc_feature (938)..(938): location 938 can be absent or Met
  Misc_feature (939)..(939): location 939 can be absent or Lys
  Misc_feature (940)..(940): location 940 can be Ile or absent or Val or Ala
  Misc_feature (941)..(941): location 941 can be absent or Lys or Arg
  Misc_feature (942)..(942): location 942 can be absent or Tyr
  Misc_feature (943)..(943): location 943 can be absent or Ser
  Misc_feature (944)..(944): location 944 can be absent or Val
  Misc_feature (945)..(945): location 945 can be absent or Gly
  Misc_feature (946)..(946): location 946 can be absent or Phe
  Misc_feature (947)..(947): location 947 can be absent or Lys
  Misc_feature (948)..(948): location 948 can be absent or Ser
  Misc_feature (949)..(949): location 949 can be absent or Asp
  Misc_feature (950)..(950): location 950 can be absent or Gly
  Misc_feature (951)..(951): location 951 can be Asn or absent or Lys
  Misc_feature (952)..(952): location 952 can be Ile or absent
  Misc_feature (953)..(953): location 953 can be absent or Thr
  Misc_feature (954)..(954): location 954 can be absent or Ala or Gly
  Misc_feature (955)..(955): location 955 can be absent or Leu
  Misc_feature (956)..(956): location 956 can be absent or His
  Misc_feature (957)..(957): location 957 can be Ile or Val or absent or Leu or Phe
  Misc_feature (958)..(958): location 958 can be absent or Asp or Glu
  Misc_feature (959)..(959): location 959 can be absent or Leu
  Misc_feature (960)..(960): location 960 can be absent or Lys or Leu or Arg or Gly
  Misc_feature (961)..(961): location 961 can be Ile or absent or Val or Met
  Misc_feature (962)..(962): location 962 can be Asn or absent
  Misc_feature (963)..(963): location 963 can be absent or Ala or Cys or Gly
  Misc_feature (964)..(964): location 964 can be absent or Gly
  Misc_feature (965)..(965): location 965 can be Ile or absent
  Misc_feature (966)..(966): location 966 can be absent or Ser or Thr
  Misc_feature (967)..(967): location 967 can be absent or Ala or Gln or Pro
  Misc_feature (968)..(968): location 968 can be absent or Asp or Glu
  Misc_feature (969)..(969): location 969 can be absent or Val or Ala or Phe or Cys
  Misc_feature (970)..(970): location 970 can be absent or Ser
  Misc_feature (971)..(971): location 971 can be absent or Pro
  Misc_feature (972)..(972): location 972 can be absent or Val or Ala
  Misc_feature (973)..(973): location 973 can be Ile or absent or Leu
  Misc_feature (974)..(974): location 974 can be absent or Pro
  Misc_feature (975)..(975): location 975 can be Tyr or absent or Val or His or Gly
  Misc_feature (976)..(976): location 976 can be Asn or absent or Ala or Thr
  Misc_feature (977)..(977): location 977 can be Ile or absent or Phe
  Misc_feature (978)..(978): location 978 can be Ile or absent or Val
  Misc_feature (979)..(979): location 979 can be absent or Glu or Ser or Gly
  Misc_feature (980)..(980): location 980 can be absent or Ala or Gly
  Misc_feature (981)..(981): location 981 can be absent or Leu
  Misc_feature (982)..(982): location 982 can be absent or Lys
  Misc_feature (983)..(983): location 983 can be absent or Lys
  Misc_feature (984)..(984): location 984 can be absent or Tyr
  Misc_feature (985)..(985): location 985 can be Asn or absent or Ser
  Misc_feature (986)..(986): location 986 can be absent or Trp
  Misc_feature (987)..(987): location 987 can be absent or Gly
  Misc_feature (988)..(988): location 988 can be absent or Ala
  Misc_feature (989)..(989): location 989 can be absent or Leu or Phe
  Misc_feature (990)..(990): location 990 can be absent or Ala or Ser
  Misc_feature (991)..(991): location 991 can be absent or Tyr or Phe
  Misc_feature (992)..(992): location 992 can be absent or Asp
  Misc_feature (993)..(993): location 993 can be Ile or Val or absent or Ala
  Misc_feature (994)..(994): location 994 can be absent or Lys or Arg
  Misc_feature (995)..(995): location 995 can be Ile or absent or Val or Leu
  Misc_feature (996)..(996): location 996 can be absent or Thr or Cys
  Misc_feature (997)..(997): location 997 can be Ile or absent or Lys
  Misc_feature (998)..(998): location 998 can be absent or Leu or Thr
  Misc_feature (999)..(999): location 999 can be Asn or absent
  Misc_feature (1000)..(1000): location 1000 can be Asn or Ile or absent or Val or Lys
  Misc_feature (1001)..(1001): location 1001 can be absent or Ala or Phe or Ser or Thr
  Misc_feature (1002)..(1002): location 1002 can be Val or absent or Ser or Thr
  Misc_feature (1003)..(1003): location 1003 can be absent or Lys or Gln or Arg
  Misc_feature (1004)..(1004): location 1004 can be absent or Lys or Ser
  Misc_feature (1005)..(1005): location 1005 can be Val or absent or Ala or Ser
  Misc_feature (1006)..(1006): location 1006 can be absent or Arg or Met
  Misc_feature (1007)..(1007): location 1007 can be absent or Leu or Arg
  Misc_feature (1008)..(1008): location 1008 can be Val or absent or Ala or Gly
  Misc_feature (1009)..(1009): location 1009 can be absent or Pro
  Misc_feature (1010)..(1010): location 1010 can be Val or absent or Gly
  Misc_feature (1011)..(1011): location 1011 can be absent or Asp or Glu or Arg
  Misc_feature (1012)..(1012): location 1012 can be Asn or absent or Val or Ala or Thr
  Misc_feature (1013)..(1013): location 1013 can be absent or Gln or Ser
  Misc_feature (1014)..(1014): location 1014 can be absent or Arg or Gly
  Misc_feature (1015)..(1015): location 1015 can be absent or Asp or Ser
  Misc_feature (1016)..(1016): location 1016 can be Ile or absent or Tyr or Phe
  Misc_feature (1017)..(1017): location 1017 can be Ile or absent or Val
  Misc_feature (1018)..(1018): location 1018 can be absent or Asp or Ala
  Misc_feature (1019)..(1019): location 1019 can be absent or Glu or Pro
  Misc_feature (1020)..(1020): location 1020 can be absent or Ala or Arg
  Misc_feature (1021)..(1021): location 1021 can be Ile or absent
  Misc_feature (1022)..(1022): location 1022 can be Ile or absent or Val or Arg
  Misc_feature (1023)..(1023): location 1023 can be absent or Glu
  Misc_feature (1024)..(1024): location 1024 can be absent or His
  Misc_feature (1025)..(1025): location 1025 can be Ile or absent or Val
  Misc_feature (1026)..(1026): location 1026 can be absent or Ala
  Misc_feature (1027)..(1027): location 1027 can be absent or Ala or Ser
  Misc_feature (1028)..(1028): location 1028 can be Ile or absent or Val or Ala or Thr
  Misc_feature (1029)..(1029): location 1029 can be absent or Leu
  Misc_feature (1030)..(1030): location 1030 can be absent or Ser or Gly
  Misc_feature (1031)..(1031): location 1031 can be absent or Val or Ala or Leu or Thr
  Misc_feature (1032)..(1032): location 1032 can be absent or Asp or Ala
  Misc_feature (1033)..(1033): location 1033 can be absent or Val or Ala or Thr
  Misc_feature (1034)..(1034): location 1034 can be Asn or absent
  Misc_feature (1035)..(1035): location 1035 can be absent or Leu or Ala or Thr
  Misc_feature (1036)..(1036): location 1036 can be Ile or absent or Val
  Misc_feature (1037)..(1037): location 1037 can be absent or Arg
  Misc_feature (1038)..(1038): location 1038 can be absent or Gln or Arg
  Misc_feature (1039)..(1039): location 1039 can be absent or Lys or Arg
  Misc_feature (1040)..(1040): location 1040 can be Asn or absent
  Misc_feature (1041)..(1041): location 1041 can be absent or Leu or Phe
  Misc_feature (1042)..(1042): location 1042 can be absent or His
  Misc_feature (1043)..(1043): location 1043 can be absent or Asp or Ser or Thr
  Misc_feature (1044)..(1044): location 1044 can be Tyr or absent or Val or Leu or Phe
  Misc_feature (1045)..(1045): location 1045 can be absent or Asp or Glu
  Misc_feature (1046)..(1046): location 1046 can be absent or Ser
  Misc_feature (1047)..(1047): location 1047 can be absent or Leu
  Misc_feature (1048)..(1048): location 1048 can be Val or absent or Lys or Ser or Thr
  Misc_feature (1049)..(1049): location 1049 can be absent or Val or Lys or Leu
  Misc_feature (1050)..(1050): location 1050 can be absent or Tyr or Phe
  Misc_feature (1051)..(1051): location 1051 can be absent or Tyr or Phe or His
  Misc_feature (1052)..(1052): location 1052 can be absent or Pro or Ser or Gly
  Misc_feature (1053)..(1053): location 1053 can be Asn or absent or Asp
  Misc_feature (1054)..(1054): location 1054 can be absent or Ala or Ser
  Misc_feature (1055)..(1055): location 1055 can be absent or Ala
  Misc_feature (1056)..(1056): location 1056 can be absent or Asp or Glu or Ala or Gly
  Misc_feature (1057)..(1057): location 1057 can be absent or Ser or Gly or Cys
  Misc_feature (1058)..(1058): location 1058 can be absent or Glu or Ala or Met
  Misc_feature (1059)..(1059): location 1059 can be absent or Glu or Ala or Gly
  Misc_feature (1060)..(1060): location 1060 can be absent or Asp or Glu or Ser
  Misc_feature (1061)..(1061): location 1061 can be absent or Ala or Pro or Ser or Thr
  Misc_feature (1062)..(1062): location 1062 can be absent or Pro or Leu or Ser
  Misc_feature (1063)..(1063): location 1063 can be absent or Ser or Gly or Thr
  Misc_feature (1064)..(1064): location 1064 can be absent or Tyr
  Misc_feature (1065)..(1065): location 1065 can be absent or Ser or Thr
  Misc_feature (1066)..(1066): location 1066 can be absent or Leu
  Misc_feature (1067)..(1067): location 1067 can be Ile or absent or Val or Pro or His
  Misc_feature (1068)..(1068): location 1068 can be Ile or absent or Asp or Ser or Thr
  Misc_feature (1069)..(1069): location 1069 can be Ile or absent
  Misc_feature (1070)..(1070): location 1070 can be absent or Phe or Cys
  Misc_feature (1071)..(1071): location 1071 can be Asn or absent or Asp
  Misc_feature (1072)..(1072): location 1072 can be absent or Lys or Gln or Arg
  Misc_feature (1073)..(1073): location 1073 can be absent or Leu
  Misc_feature (1074)..(1074): location 1074 can be Ile or absent or Ala
  Misc_feature (1075)..(1075): location 1075 can be absent or Ser or Thr
  Misc_feature (1076)..(1076): location 1076 can be absent or Ser or Thr
  Misc_feature (1077)..(1077): location 1077 can be absent or Ala or Pro or Ser
  Misc_feature (1078)..(1078): location 1078 can be Asn or absent or Glu or Arg
  Misc_feature (1079)..(1079): location 1079 can be absent or Tyr
  Misc_feature (1080)..(1080): location 1080 can be absent or Leu or Gln or Arg
  Misc_feature (1081)..(1081): location 1081 can be absent or Gln or Ser or Arg or His
  Misc_feature (1082)..(1082): location 1082 can be absent or Gln or Arg
  Misc_feature (1083)..(1083): location 1083 can be Val or absent or Leu or Ala
  Misc_feature (1084)..(1084): location 1084 can be absent or Glu or Ala
  Misc_feature (1085)..(1085): location 1085 can be Val or absent or Ala or Ser or Met
  Misc_feature (1086)..(1086): location 1086 can be Ile or absent or Val
  Misc_feature (1087)..(1087): location 1087 can be absent or Lys or Glu or Arg
  Misc_feature (1088)..(1088): location 1088 can be absent or Lys or Gln or Arg or Ser or His
  Misc_feature (1089)..(1089): location 1089 can be absent or Phe
  Misc_feature (1090)..(1090): location 1090 can be Asn or absent
  Misc_feature (1091)..(1091): location 1091 can be absent or Lys or Ala or Ser or Gly
  Misc_feature (1092)..(1092): location 1092 can be absent or Ser or Thr or Gly
  Misc_feature (1093)..(1093): location 1093 can be Asn or absent or Ser
  Misc_feature (1094)..(1094): location 1094 can be absent or Lys or Arg
  Misc_feature (1095)..(1095): location 1095 can be absent or Trp
  Misc_feature (1096)..(1096): location 1096 can be absent or Lys or Arg
  Misc_feature (1097)..(1097): location 1097 can be absent or Lys
  Misc_feature (1098)..(1098): location 1098 can be absent or Arg
  Misc_feature (1099)..(1099): location 1099 can be absent or Gly
  Misc_feature (1100)..(1100): location 1100 can be Ile or absent or Leu
  Misc_feature (1101)..(1101): location 1101 can be absent or Ser
  Misc_feature (1102)..(1102): location 1102 can be absent or Val or Ser or Cys
  Misc_feature (1103)..(1103): location 1103 can be absent or Val
  Misc_feature (1104)..(1104): location 1104 can be absent or Pro
  Misc_feature (1105)..(1105): location 1105 can be Ile or absent or Leu
  Misc_feature (1106)..(1106): location 1106 can be Ile or absent or Val or Thr
  Misc_feature (1107)..(1107): location 1107 can be absent or Tyr or Phe or His
  Misc_feature (1108)..(1108): location 1108 can be absent or Lys or Asp or Glu or Ser
  Misc_feature (1109)..(1109): location 1109 can be absent or Val or Phe
  Misc_feature (1110)..(1110): location 1110 can be absent or Glu or Ala or Arg or Thr
  Misc_feature (1111)..(1111): location 1111 can be absent or Pro or Leu or Ser
  Misc_feature (1112)..(1112): location 1112 can be absent or Arg
  Misc_feature (1113)..(1113): location 1113 can be absent or Pro
  Misc_feature (1114)..(1114): location 1114 can be absent or Ala or Ser or Thr
  Misc_feature (1115)..(1115): location 1115 can be absent or Pro
  Misc_feature (1116)..(1116): location 1116 can be absent or Gly
  Misc_feature (1117)..(1117): location 1117 can be absent or Lys or Arg
  Misc_feature (1118)..(1118): location 1118 can be absent or Val
  Misc_feature (1119)..(1119): location 1119 can be absent or Ser
  Misc_feature (1120)..(1120): location 1120 can be Ile or Val or absent
  Misc_feature (1121)..(1121): location 1121 can be absent or Leu or Met
  Misc_feature (1122)..(1122): location 1122 can be Asn or absent
  Misc_feature (1123)..(1123): location 1123 can be absent or Asp
  Misc_feature (1124)..(1124): location 1124 can be absent or Gly
  Misc_feature (1125)..(1125): location 1125 can be absent or Ser
  Misc_feature (1126)..(1126): location 1126 can be Ile or absent or Val
  Misc_feature (1127)..(1127): location 1127 can be Val or absent or Ala
  Misc_feature (1128)..(1128): location 1128 can be absent or Val
  Misc_feature (1129)..(1129): location 1129 can be absent or Glu
  Misc_feature (1130)..(1130): location 1130 can be absent or Val
  Misc_feature (1131)..(1131): location 1131 can be absent or Gly
  Misc_feature (1132)..(1132): location 1132 can be absent or Gly
  Misc_feature (1133)..(1133): location 1133 can be Ile or absent or Val
  Misc_feature (1134)..(1134): location 1134 can be absent or Glu
  Misc_feature (1135)..(1135): location 1135 can be Ile or absent or Leu
  Misc_feature (1136)..(1136): location 1136 can be absent or Gly
  Misc_feature (1137)..(1137): location 1137 can be absent or Gln
  Misc_feature (1138)..(1138): location 1138 can be absent or Gly
  Misc_feature (1139)..(1139): location 1139 can be absent or Leu
  Misc_feature (1140)..(1140): location 1140 can be Tyr or absent or Trp
  Misc_feature (1141)..(1141): location 1141 can be absent or Thr
  Misc_feature (1142)..(1142): location 1142 can be absent or Lys
  Misc_feature (1143)..(1143): location 1143 can be absent or Val
  Misc_feature (1144)..(1144): location 1144 can be absent or Lys or Gln
  Misc_feature (1145)..(1145): location 1145 can be absent or Gln
  Misc_feature (1146)..(1146): location 1146 can be absent or Met
  Misc_feature (1147)..(1147): location 1147 can be absent or Ala or Thr
  Misc_feature (1148)..(1148): location 1148 can be absent or Ala
  Misc_feature (1149)..(1149): location 1149 can be absent or Phe
  Misc_feature (1150)..(1150): location 1150 can be absent or Ala or Gly
  Misc_feature (1151)..(1151): location 1151 can be absent or Leu
  Misc_feature (1152)..(1152): location 1152 can be absent or Arg or Gly
  Misc_feature (1153)..(1153): location 1153 can be absent or Glu or Gln
  Misc_feature (1154)..(1154): location 1154 can be absent or Leu
  Misc_feature (1155)..(1155): location 1155 can be absent or Trp or Cys
  Misc_feature (1156)..(1156): location 1156 can be absent or Asp or Pro or Thr
  Misc_feature (1157)..(1157): location 1157 can be absent or Lys or Asp
  Misc_feature (1158)..(1158): location 1158 can be absent or Ala or Arg or Gly
  Misc_feature (1159)..(1159): location 1159 can be absent or Asp or Arg or Cys or Gly
  Misc_feature (1160)..(1160): location 1160 can be absent or Glu or Gln or Gly
  Misc_feature (1161)..(1161): location 1161 can be absent or Glu or Gly
  Misc_feature (1162)..(1162): location 1162 can be absent or Leu
  Misc_feature (1163)..(1163): location 1163 can be Ile or absent or Leu
  Misc_feature (1164)..(1164): location 1164 can be absent or Asp or Glu
  Misc_feature (1165)..(1165): location 1165 can be Asn or absent or Lys or Arg
  Misc_feature (1166)..(1166): location 1166 can be Ile or absent or Val
  Misc_feature (1167)..(1167): location 1167 can be absent or Arg
  Misc_feature (1168)..(1168): location 1168 can be Ile or absent or Val
  Misc_feature (1169)..(1169): location 1169 can be Ile or absent or Leu
  Misc_feature (1170)..(1170): location 1170 can be absent or Gln
  Misc_feature (1171)..(1171): location 1171 can be absent or Ala or Ser
  Misc_feature (1172)..(1172): location 1172 can be absent or Asp
  Misc_feature (1173)..(1173): location 1173 can be absent or Thr
  Misc_feature (1174)..(1174): location 1174 can be absent or Leu
  Misc_feature (1175)..(1175): location 1175 can be Asn or absent or Ser
  Misc_feature (1176)..(1176): location 1176 can be absent or Val or Leu or Met
  Misc_feature (1177)..(1177): location 1177 can be Ile or absent
  Misc_feature (1178)..(1178): location 1178 can be absent or Gln
  Misc_feature (1179)..(1179): location 1179 can be absent or Gly
  Misc_feature (1180)..(1180): location 1180 can be absent or Ser or Gly
  Misc_feature (1181)..(1181): location 1181 can be absent or Trp or Leu or Phe
  Misc_feature (1182)..(1182): location 1182 can be absent or Thr
  Misc_feature (1183)..(1183): location 1183 can be absent or Ala or Thr or Gly
  Misc_feature (1184)..(1184): location 1184 can be absent or Gly
  Misc_feature (1185)..(1185): location 1185 can be absent or Ser
  Misc_feature (1186)..(1186): location 1186 can be absent or Thr
  Misc_feature (1187)..(1187): location 1187 can be absent or Thr
  Misc_feature (1188)..(1188): location 1188 can be absent or Ser
  Misc_feature (1189)..(1189): location 1189 can be absent or Glu
  Misc_feature (1190)..(1190): location 1190 can be absent or Ser or Thr
  Misc_feature (1191)..(1191): location 1191 can be absent or Ser
  Misc_feature (1192)..(1192): location 1192 can be absent or Cys
  Misc_feature (1193)..(1193): location 1193 can be absent or Glu or Ala
  Misc_feature (1194)..(1194): location 1194 can be absent or Ala
  Misc_feature (1195)..(1195): location 1195 can be absent or Val or Thr
  Misc_feature (1196)..(1196): location 1196 can be absent or Leu or His or Arg
  Misc_feature (1197)..(1197): location 1197 can be absent or Lys or Gln or Arg
  Misc_feature (1198)..(1198): location 1198 can be absent or Ala or Ser
  Misc_feature (1199)..(1199): location 1199 can be absent or Cys
  Misc_feature (1200)..(1200): location 1200 can be Asn or absent or Ala or Thr
  Misc_feature (1201)..(1201): location 1201 can be Ile or Val or absent or Ala or Met
  Misc_feature (1202)..(1202): location 1202 can be absent or Leu
  Misc_feature (1203)..(1203): location 1203 can be Ile or absent or Val or Phe
  Misc_feature (1204)..(1204): location 1204 can be absent or Asp or Glu
  Misc_feature (1205)..(1205): location 1205 can be absent or Arg
  Misc_feature (1206)..(1206): location 1206 can be absent or Leu
  Misc_feature (1207)..(1207): location 1207 can be absent or Lys
  Misc_feature (1208)..(1208): location 1208 can be absent or Pro
  Misc_feature (1209)..(1209): location 1209 can be Ile or Val or absent or Leu
  Misc_feature (1210)..(1210): location 1210 can be absent or Lys or Met
  Misc_feature (1211)..(1211): location 1211 can be absent or Asp or Glu
  Misc_feature (1212)..(1212): location 1212 can be absent or Lys or Gln or Ser or Arg
  Misc_feature (1213)..(1213): location 1213 can be absent or Leu or Ala
  Misc_feature (1214)..(1214): location 1214 can be absent or Glu or Gln or Gly
  Misc_feature (1215)..(1215): location 1215 can be absent or Glu or Ala or Leu or Thr
  Misc_feature (1216)..(1216): location 1216 can be absent or Lys or Leu or Gln or Pro or Gly
  Misc_feature (1217)..(1217): location 1217 can be absent or Pro
  Misc_feature (1218)..(1218): location 1218 can be absent or Trp or Gly
  Misc_feature (1219)..(1219): location 1219 can be absent or Lys or Ala or Gln or Ser
  Misc_feature (1220)..(1220): location 1220 can be absent or Asp or Ala or Ser or Gly
  Misc_feature (1221)..(1221): location 1221 can be absent or Ala or Leu or Phe or Thr
  Misc_feature (1222)..(1222): location 1222 can be Ile or absent or Val or Pro
  Misc_feature (1223)..(1223): location 1223 can be Trp or absent or Ala or Ser
  Misc_feature (1224)..(1224): location 1224 can be absent or Trp or Gln or Ser
  Misc_feature (1225)..(1225): location 1225 can be absent or Asp or Ala
  Misc_feature (1226)..(1226): location 1226 can be absent or Glu or Leu or Ser or Thr
  Misc_feature (1227)..(1227): location 1227 can be Ile or absent or Leu or Met
  Misc_feature (1228)..(1228): location 1228 can be Ile or absent or Ala
  Misc_feature (1229)..(1229): location 1229 can be absent or Gln or Ser
  Misc_feature (1230)..(1230): location 1230 can be absent or Val or Ala or Gln
  Misc_feature (1231)..(1231): location 1231 can be absent or Lys or Ala
  Misc_feature (1232)..(1232): location 1232 can be absent or Lys or Leu or Met or Ser
  Misc_feature (1233)..(1233): location 1233 can be absent or Ala or Gln or Met or Thr
  Misc_feature (1234)..(1234): location 1234 can be absent or Val or Glu or Ser
  Misc_feature (1235)..(1235): location 1235 can be Asn or Val or absent or His or Gly
  Misc_feature (1236)..(1236): location 1236 can be Asn or Ile or absent or Val or Ala
  Misc_feature (1237)..(1237): location 1237 can be Asn or absent or Tyr or Asp or Leu
  Misc_feature (1238)..(1238): location 1238 can be absent or Trp or Leu or Ser
  Misc_feature (1239)..(1239): location 1239 can be absent or Ala or Ser or Thr
  Misc_feature (1240)..(1240): location 1240 can be absent or Ala or Pro or His
  Misc_feature (1241)..(1241): location 1241 can be absent or Lys or Asp or Ala or Ser
  Misc_feature (1242)..(1242): location 1242 can be Tyr or absent or Glu or Ala or Pro
  Misc_feature (1243)..(1243): location 1243 can be Trp or Tyr or absent or Leu or Thr
  Misc_feature (1244)..(1244): location 1244 can be Trp or absent or Tyr or Lys or Phe
  Misc_feature (1245)..(1245): location 1245 can be absent or Val or Pro or Thr
  Misc_feature (1246)..(1246): location 1246 can be absent or Pro or Ser or Gly
  Misc_feature (1247)..(1247): location 1247 can be absent or Tyr or Glu or Pro or Gly
  Misc_feature (1248)..(1248): location 1248 can be absent or Ala or Gln or Leu or Met
  Misc_feature (1249)..(1249): location 1249 can be Asn or absent or Asp or Ala or Phe
  Misc_feature (1250)..(1250): location 1250 can be absent or Arg or Ser
  Misc_feature (1251)..(1251): location 1251 can be absent or Asn or Lys or Gly
  Misc_feature (1252)..(1252): location 1252 can be absent or Ile or Phe or Ser
  Misc_feature (1253)..(1253): location 1253 can be absent or Tyr or His
  Misc_feature (1254)..(1254): location 1254 can be absent or Pro or Leu
  Misc_feature (1255)..(1255): location 1255 can be absent or Asn or Pro
  Misc_feature (1256)..(1256): location 1256 can be absent or Tyr or Thr
  Misc_feature (1257)..(1257): location 1257 can be absent or Gly
  Misc_feature (1258)..(1258): location 1258 can be absent or Ala
  Misc_feature (1259)..(1259): location 1259 can be absent or Ala or Gly
  Misc_feature (1260)..(1260): location 1260 can be Ile or Val or absent or Ala or Thr
  Misc_feature (1261)..(1261): location 1261 can be absent or Ser
  Misc_feature (1262)..(1262): location 1262 can be absent or Glu
  Misc_feature (1263)..(1263): location 1263 can be absent or Val
  Misc_feature (1264)..(1264): location 1264 can be absent or Glu
  Misc_feature (1265)..(1265): location 1265 can be Ile or absent or Val
  Misc_feature (1266)..(1266): location 1266 can be absent or Asp
  Misc_feature (1267)..(1267): location 1267 can be absent or Val or Leu
  Misc_feature (1268)..(1268): location 1268 can be absent or Leu
  Misc_feature (1269)..(1269): location 1269 can be absent or Thr
  Misc_feature (1270)..(1270): location 1270 can be absent or Gly
  Misc_feature (1271)..(1271): location 1271 can be absent or Glu or Ala
  Misc_feature (1272)..(1272): location 1272 can be Ile or absent or Thr
  Misc_feature (1273)..(1273): location 1273 can be absent or Thr
  Misc_feature (1274)..(1274): location 1274 can be Ile or absent
  Misc_feature (1275)..(1275): location 1275 can be Ile or absent or Leu or Met
  Misc_feature (1276)..(1276): location 1276 can be absent or Gln or Arg
  Misc_feature (1277)..(1277): location 1277 can be absent or Ser or Thr
  Misc_feature (1278)..(1278): location 1278 can be absent or Asp
  Misc_feature (1279)..(1279): location 1279 can be Ile or absent or Leu
  Misc_feature (1280)..(1280): location 1280 can be Ile or absent or Val or Leu
  Misc_feature (1281)..(1281): location 1281 can be absent or Tyr
  Misc_feature (1282)..(1282): location 1282 can be absent or Asp
  Misc_feature (1283)..(1283): location 1283 can be absent or Ser or Cys
  Misc_feature (1284)..(1284): location 1284 can be absent or Gly
  Misc_feature (1285)..(1285): location 1285 can be absent or Lys or Gln or Arg
  Misc_feature (1286)..(1286): location 1286 can be absent or Ser
  Misc_feature (1287)..(1287): location 1287 can be absent or Leu
  Misc_feature (1288)..(1288): location 1288 can be Asn or absent
  Misc_feature (1289)..(1289): location 1289 can be absent or Pro
  Misc_feature (1290)..(1290): location 1290 can be absent or Ala
  Misc_feature (1291)..(1291): location 1291 can be absent or Val
  Misc_feature (1292)..(1292): location 1292 can be absent or Asp
  Misc_feature (1293)..(1293): location 1293 can be absent or Leu
  Misc_feature (1294)..(1294): location 1294 can be absent or Gly
  Misc_feature (1295)..(1295): location 1295 can be absent or Gln
  Misc_feature (1296)..(1296): location 1296 can be Ile or absent or Val
  Misc_feature (1297)..(1297): location 1297 can be absent or Glu
  Misc_feature (1298)..(1298): location 1298 can be absent or Ser or Gly
  Misc_feature (1299)..(1299): location 1299 can be absent or Ala or Ser
  Misc_feature (1300)..(1300): location 1300 can be absent or Phe
  Misc_feature (1301)..(1301): location 1301 can be Ile or absent or Val
  Misc_feature (1302)..(1302): location 1302 can be absent or Gln
  Misc_feature (1303)..(1303): location 1303 can be absent or Gly
  Misc_feature (1304)..(1304): location 1304 can be Ile or absent or Val or Leu
  Misc_feature (1305)..(1305): location 1305 can be absent or Xaa or Gly
  Misc_feature (1306)..(1306): location 1306 can be absent or Tyr or Phe
  Misc_feature (1307)..(1307): location 1307 can be absent or Phe
  Misc_feature (1308)..(1308): location 1308 can be Ile or absent or Met or Thr
  Misc_feature (1309)..(1309): location 1309 can be Asn or Tyr or absent or Leu
  Misc_feature (1310)..(1310): location 1310 can be absent or Glu
  Misc_feature (1311)..(1311): location 1311 can be absent or Asp or Glu
  Misc_feature (1312)..(1312): location 1312 can be absent or Tyr or His
  Misc_feature (1313)..(1313): location 1313 can be Ile or absent or Val or Gln or Ala or Thr
  Misc_feature (1314)..(1314): location 1314 can be absent or Thr
  Misc_feature (1315)..(1315): location 1315 can be Asn or absent or Asp
  Misc_feature (1316)..(1316): location 1316 can be absent or Ala or Ser
  Misc_feature (1317)..(1317): location 1317 can be absent or Asp or Glu
  Misc_feature (1318)..(1318): location 1318 can be absent or Gly
  Misc_feature (1319)..(1319): location 1319 can be absent or Leu
  Misc_feature (1320)..(1320): location 1320 can be absent or Val or Leu or Arg
  Misc_feature (1321)..(1321): location 1321 can be Ile or absent or Val or Leu
  Misc_feature (1322)..(1322): location 1322 can be Asn or absent or His or Ser or Thr
  Misc_feature (1323)..(1323): location 1323 can be Asn or absent or Asp
  Misc_feature (1324)..(1324): location 1324 can be absent or Ser or Gly
  Misc_feature (1325)..(1325): location 1325 can be absent or Thr
  Misc_feature (1326)..(1326): location 1326 can be absent or Trp
  Misc_feature (1327)..(1327): location 1327 can be absent or Asp or Thr
  Misc_feature (1328)..(1328): location 1328 can be absent or Tyr
  Misc_feature (1329)..(1329): location 1329 can be absent or Lys
  Misc_feature (1330)..(1330): location 1330 can be Ile or absent
  Misc_feature (1331)..(1331): location 1331 can be absent or Pro
  Misc_feature (1332)..(1332): location 1332 can be absent or Ser or Thr
  Misc_feature (1333)..(1333): location 1333 can be absent or Val
  Misc_feature (1334)..(1334): location 1334 can be absent or Asp
  Misc_feature (1335)..(1335): location 1335 can be absent or Thr
  Misc_feature (1336)..(1336): location 1336 can be Ile or absent
  Misc_feature (1337)..(1337): location 1337 can be absent or Pro
  Misc_feature (1338)..(1338): location 1338 can be absent or Lys or Arg
  Misc_feature (1339)..(1339): location 1339 can be absent or Gln
  Misc_feature (1340)..(1340): location 1340 can be absent or Phe
  Misc_feature (1341)..(1341): location 1341 can be Asn or absent
  Misc_feature (1342)..(1342): location 1342 can be absent or Val or Ala
  Misc_feature (1343)..(1343): location 1343 can be absent or Lys or Glu
  Misc_feature (1344)..(1344): location 1344 can be Ile or Val or absent or Leu
  Misc_feature (1345)..(1345): location 1345 can be Ile or absent or Leu
  Misc_feature (1346)..(1346): location 1346 can be Asn or absent or Ser
  Misc_feature (1347)..(1347): location 1347 can be absent or Ser or Thr
  Misc_feature (1348)..(1348): location 1348 can be absent or Ala or Gly
  Misc_feature (1349)..(1349): location 1349 can be Tyr or absent or Phe or His or Arg
  Misc_feature (1350)..(1350): location 1350 can be absent or Asp or Glu or His
  Misc_feature (1351)..(1351): location 1351 can be Asn or absent or Lys or Glu or Gln or His
  Misc_feature (1352)..(1352): location 1352 can be absent or Lys or Ser or His
  Misc_feature (1353)..(1353): location 1353 can be absent or Arg or Gly
  Misc_feature (1354)..(1354): location 1354 can be absent or Val
  Misc_feature (1355)..(1355): location 1355 can be absent or Leu
  Misc_feature (1356)..(1356): location 1356 can be absent or Ser
  Misc_feature (1357)..(1357): location 1357 can be absent or Ser
  Misc_feature (1358)..(1358): location 1358 can be absent or Lys
  Misc_feature (1359)..(1359): location 1359 can be absent or Ala or Gly
  Misc_feature (1360)..(1360): location 1360 can be absent or Ser
  Misc_feature (1361)..(1361): location 1361 can be absent or Gly
  Misc_feature (1362)..(1362): location 1362 can be absent or Lys or Glu
  Misc_feature (1363)..(1363): location 1363 can be absent or Pro
  Misc_feature (1364)..(1364): location 1364 can be absent or Ala or Pro
  Misc_feature (1365)..(1365): location 1365 can be Val or absent or Leu
  Misc_feature (1366)..(1366): location 1366 can be Val or absent or Leu
  Misc_feature (1367)..(1367): location 1367 can be absent or Leu
  Misc_feature (1368)..(1368): location 1368 can be absent or Ala or Gly
  Misc_feature (1369)..(1369): location 1369 can be absent or Leu or Ala or Ser
  Misc_feature (1370)..(1370): location 1370 can be absent or Ser
  Misc_feature (1371)..(1371): location 1371 can be absent or Val
  Misc_feature (1372)..(1372): location 1372 can be absent or His
  Misc_feature (1373)..(1373): location 1373 can be absent or Cys
  Misc_feature (1374)..(1374): location 1374 can be absent or Pro or Ala
  Misc_feature (1375)..(1375): location 1375 can be Ile or Val or Met or Thr
  Misc_feature (1379)..(1379): location 1379 can be Ile or Val
  Misc_feature (1380)..(1380): location 1380 can be Lys or Arg
  Misc_feature (1381)..(1381): location 1381 can be Glu or Ala
  Misc_feature (1384)..(1384): location 1384 can be Ile or Lys or Glu or Arg or Thr
  Misc_feature (1385)..(1385): location 1385 can be Asp or Glu or Gln
  Misc_feature (1386)..(1386): location 1386 can be Tyr or Leu or Phe
  Misc_feature (1387)..(1387): location 1387 can be Pro or Ala or Arg or Ser or His
  Misc_feature (1388)..(1388): location 1388 can be Val or Ala or Met or Cys or Gly
  Misc_feature (1389)..(1389): location 1389 can be Asn or Trp or Val or Ala or Ser or Cys
  Misc_feature (1390)..(1390): location 1390 can be Asn or Lys or Ser or Arg or Thr or Gly
  Misc_feature (1391)..(1391): location 1391 can be absent or Gly
  Misc_feature (1392)..(1392): location 1392 can be absent or Pro or Gly
  Misc_feature (1393)..(1393): location 1393 can be absent or Thr
  Misc_feature (1394)..(1394): location 1394 can be absent or Gly
  Misc_feature (1395)..(1395): location 1395 can be Val or absent or Ser or Gly
  Misc_feature (1396)..(1396): location 1396 can be Asn or absent or Ala or Ser or Gly
  Misc_feature (1397)..(1397): location 1397 can be Asn or absent or Asp or Ser
  Misc_feature (1398)..(1398): location 1398 can be absent or Gln or Phe or Ser
  Misc_feature (1399)..(1399): location 1399 can be Val or Glu or Leu or Ala or Pro or Ser or Thr
  Misc_feature (1400)..(1400): location 1400 can be Ile or Pro or Leu or Thr
  Misc_feature (1401)..(1401): location 1401 can be Phe or Met or Ser or Thr
  Misc_feature (1403)..(1403): location 1403 can be Asp or Gln
  Misc_feature (1404)..(1404): location 1404 can be Leu or Met
  Misc_feature (1405)..(1405): location 1405 can be Asp or Glu or Pro
  Misc_feature (1409)..(1409): location 1409 can be Ile or Pro or Thr
  Misc_feature (1411)..(1411): location 1411 can be Ala or Pro or Thr
  Misc_feature (1412)..(1412): location 1412 can be Ile or Val or Asp or Ala or Thr
  Misc_feature (1413)..(1413): location 1413 can be Ile or Val
  Misc_feature (1421)..(1421): location 1421 can be Ile or Asn or Val
  Misc_feature (1424)..(1424): location 1424 can be Lys or Ser or Arg
  Misc_feature (1425)..(1425): location 1425 can be Tyr or Asp or His
  Misc_feature (1426)..(1426): location 1426 can be Leu or Phe
  Misc_feature (1427)..(1427): location 1427 can be Glu or Gln
  Misc_feature (1428)..(1428): location 1428 can be Trp or Asp or Ser
  Misc_feature (1429)..(1429): location 1429 can be Ile or Val or Pro or Leu or Phe or Met
  Misc_feature (1430)..(1430): location 1430 can be Pro or Ala or Ser or Cys
  Misc_feature (1431)..(1431): location 1431 can be Asn or Ala or Ser
  Misc_feature (1432)..(1432): location 1432 can be Val or Lys or Ala or Arg or Thr
  Misc_feature (1433)..(1433): location 1433 can be Asn or absent or Ala or Ser or Thr or Gly
  Misc_feature (1434)..(1434): location 1434 can be absent or Glu or Ala or Pro
  Misc_feature (1435)..(1435): location 1435 can be Val or absent or Ala or Thr
  Misc_feature (1436)..(1436): location 1436 can be Asn or absent or Ala or Pro or Ser
  Misc_feature (1437)..(1437): location 1437 can be absent or Gly or Thr
  Misc_feature (1438)..(1438): location 1438 can be Asn or absent or Ala or Pro
  Misc_feature (1439)..(1439): location 1439 can be Val or absent or Lys or Gln
  Misc_feature (1440)..(1440): location 1440 can be absent or Ala
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXYDXGXSLNPAVDLGQXEGAFXQGXGFFXXEXYXTNXDGLXXXDXTWTYKIPTVDTIPKQFNVEXXXXXXXXKRVLSSKASGEPPLLLAXSVHCAXREAIRAARXEFXXXXGXXXXXXXXXTFQMDVPATMPXVKELCGLDVVEXYLESXXXXXXXXXXXX

SEQ ID NO: 10033 - DNA, 14437 bp, Unknown
  Artificial
  pMON74916
atgtcttcctcgaggcctgcccactcttcaagttcatccagcaggactcgccagagctcccgggcaaggatattagcacaaacaacccttgatgctgaactcaatgcagagtacgaagaatctggtgattcctttgattactccaagttggttgaagcacagcggagcactccacctgagcagcaagggcgatcgggaaaggtcatagcctacttgcagcatattcaaagaggaaagcttatccaaccatttggttgcctgttggcccttgacgagaagagcttcagggtcattgcattcagtgagaatgcacctgaaatgcttacaacggtcagccatgctgtgccaaacgttgatgatcccccgaagctaggaattggtaccaatgtgcgctcccttttcactgaccctggtgctacagcactgcagaaggcacttggatttgctgatgtttctttgctgaatcctatcctggttcagtgcaagacctcaggcaagccattctatgccattgttcacagggcaactggttgtctggtggtagattttgagcctgtgaagcctacagaatttcctgccactgctgctggggctttgcagtcctacaagcttgctgccaaggcaatctccaagatccagtcactactaggtggaagcatggaggccttatgcaataccgtggttaaggaagtctttgacctgacaggttatgacagggttatggcttacaagttccatgaagatgagcatggggaggtctttgctgagatcaccaaacctggtattgagccctatataggcctgcactatccagccactgatatccctcaagctgccaggtttctcttcatgaagaacaaagtcagaatgatctgtgattgccgtgcaagatccgtgaagattattgaagatgaggcactctccattgatattagcttgtgtggttcaactcttagagcaccacatagctgtcaccttaagtatatggagaacatgaactcgattgcatctcttgtcatggctgttgtggtcaatgaaaatgaagaggatgatgaacccgagcctgaacaaccaccacaacagcagaagaagaagaggctgtggggtctcattgtttgccaccatgagagccccagatatgtcccgttcccactgcggtatgcctgtgaattcttggcccaagtgtttgctgtccatgtaaacaaggagtttgaattggagaagcagatacgagagaaaaacattctgcgaatgcaaacaatgctctctgacatgctgttcaaggaatcatctcccttgagtatcgtgtctgggagtccaaatatcatggacctagttaagtgtgatggcgctgctcttttgtatggggacaaagtatggcggcttcaaacggctccaaccgagtctcagattcgtgatattgccttctggctttcagaagttcatggggattccactggcttgagtactgatagcctccaggatgctggatatccaggagctgcttcccttggtgacatgatttgtggaatggcagtggccaagatcacgtccaaggacattcttttctggttcaggtcacatacagctgctgaaatcaaatggggaggtgcaaagcatgatccatctgataaggatgacaacagaaggatgcaccctaggttatcctttaaggctttccttgaggttgtcaagacgaagagtttgccatggagtgactacgagatggatgctattcactcattgcagcttattcttagaggtacactgaatgatgcctcgaagccagcccaggcatctggtttagataaccagatcggtgatctaaaacttgatgggcttgctgaattgcaagcagtgacaagtgaaatggtccgcctgatggaaacagcaactgttccgatcttggcagtagatggcaatggattggtcaatggatggaaccaaaaggtagcggagttgtcaggtctgagagttgatgaggctataggaagacacatacttacacttgtggaggattcttctgtatcacttgttcagaggatgctatatttagctctgcaaggtgagtggaactaaaaggttttaagcacctttactgtctgcaccatttaattactattcttactgttaatagtcaaccctcagaaaaaatgaataaatttattgtattacgtattggtttctgaatatttcatcaattgagcaggcagagaagagaaggaagttcgatttgagctgaaaacacatggctccaagagggatgatggccctgttatcttggtcgtaaatgcttgtgccagtcgtgatcttcatgaccatgttgttggggtgtgctttgtagcccaggacatgactgttcacaagttggtcatggacaaatttactcgggtcgagggggactacaaggcaatcatccacaacccgaacccactcattcctcctatatttggtgctgaccagtttggatggtgctctgagtggaatgcagccatgaccaagcttaccgggtggcacagagatgaagtggttgataagatgctccttggcgaggtttttaacagcagcaatgcttcctgccttctgaagagcaaagatgcctttgtacgtctttgcattgtcatcaacagtgcattagctggtgaagaggcagaaaaggcttcattcggcttctttgaccgcaatgagaaatatgtcgaatgccttctgtcggtgaacaggaaagtaaatgcagatggtgttgtcactggagtgttctgtttcatccatgttcctagtgatgacctgcagcatgcgctacatgtgcagcaagcctctgagcagacagcacaaagaaagttgaaggctttctcgtacatgcgacatgccatcaacaaacctctctcaggtatgctttattctagggaaacactcaagagcacaggtctgaatgaagagcagatgaggcaggttcgcgtcggagacaattgccatcgccagctaagcaagatacttgccgacttggatcaagataacatcactgacaagtaaccttcttgccaagtcttttaaactgttctattaggttcttgtatttatttccgtcttcctcgtaatttgacaattttctgaacagtaggttgatggtatcacttaattttacttcactagctactgaagcttatagccatattcgttacaaccaacttaatatttctgtatcattatgttcacaggtcaagctgcttggatttggatatggctgaatttgtgttgcaagatgtggtggtgtctgctgtaagtcaagtgctgataggttgccaggctaaaggtatcagagttgcttgcaacctgccggagagatccatgaagcaaagggtttacggggatggtatccgactccagcagatcgtctccgacttcctatttgtttcggtgaagttctctcctgctggtggctctgttgacatctcttccaagctgactaagaacagcattggggaaaaccttcacctcatagacttcgaacttaggtatgctgggcatgctagtttgcaagcatacattcatttctgaactggaaagcatgaggtgtgaaggcttaagttactcttgtgtttatggctttatgattttcaggatcaagcaccgaggagcaggagtcccagcggaaatattgtcgcaaatgtatgaggaggacaataaagagcagtcagaggagggcttcagccttgctgtttctagaaaccttctgaggctcatgaatggtgacattcgtcacctcagggaagctggcatgtcaaccttcattctcactgctgaacttgctgctgctccttcagcagttggacgatgatgaatcgattgatccaaagggcgaattctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattagatctgtgtgtgttttttggatccccggggcggccgctcgagcaggacctgcagaagctagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatttggcgcgccaaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatttgcggccgcgttaacaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccagcccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgccgcccagatcggtgcgcgggaggggcgggatctcgcggctggctctcgcccccgtggatccggcccggatctcgcggggaatggggctctcggatgtagatctgcgatccgccgttgttggggccgatgatggggcccttaaaatttccgccgtgctaaacaagatcaggaagaggggaaaagggcactatggtttatatttttatatatttctgctgcttcgtcaggcttagatgtgctagatctttctttcttctttttgtgggtagaatttaatccctcagcattgttcatcggtagtttttcttttcatgattcgtgacaaatgcagcctcgtgcggacgtttttttgtaggtagaagtgatcaac
